US008129114B2

(12) United States Patent
Ford et al.

(10) Patent No.: US 8,129,114 B2
(45) Date of Patent: Mar. 6, 2012

(54) BIOMARKERS AND METHODS FOR DETERMINING SENSITIVITY TO EPIDERMAL GROWTH FACTOR RECEPTOR MODULATORS

(75) Inventors: Shirin K. Ford, Princeton, NJ (US); Edwin A. Clark, Pennington, NJ (US); Xin Huang, Princeton, NJ (US)

(73) Assignee: Bristol-Myers Squibb Company, Princeton, NJ (US)

( * ) Notice: Subject to any disclaimer, the term of this patent is extended or adjusted under 35 U.S.C. 154(b) by 795 days.

(21) Appl. No.: 11/990,713

(22) PCT Filed: Aug. 24, 2006

(86) PCT No.: PCT/US2006/033073
§ 371 (c)(1),
(2), (4) Date: Feb. 20, 2008

(87) PCT Pub. No.: WO2007/025044
PCT Pub. Date: Mar. 1, 2007

(65) Prior Publication Data
US 2010/0221754 A1 Sep. 2, 2010

Related U.S. Application Data

(60) Provisional application No. 60/711,054, filed on Aug. 24, 2005.

(51) Int. Cl.
*C12Q 1/68* (2006.01)
*G01N 33/574* (2006.01)
*A61K 39/395* (2006.01)
(52) U.S. Cl. .......................... 435/6.1; 435/7.23; 424/130.1
(58) Field of Classification Search .................... None
See application file for complete search history.

(56) References Cited

U.S. PATENT DOCUMENTS
4,535,058 A   8/1985 Weinberg et al.
(Continued)

FOREIGN PATENT DOCUMENTS
WO   WO9116051   10/1991
(Continued)

OTHER PUBLICATIONS

Khambata-Ford et al , J Clin Onco, 25:3230-37, Auguest 2007.*
De Bono et al, Trends in Mole Med vol. 8, S19-26, 2002.*
Rothbauer et al, Recent reslt Cancer Res. 2003 :115-32, abstract only.*
Kopp et al, Recent Results Cancer Res 162:115-32, 2003.*
Lee et al, Int J Cancer 107: 528-534, 2003.*
Alizadeh, A. et al., "Distinct types of diffuse large B-cell lymphoma identified by gene expression profiling", Nature, vol. 403, pp. 503-511 (2000).
Alon, U. et al., "Broad patterns of gene expression revealed by clustering analysis of tumor and normal colon tissues probed by oligonucleotide arrays", PNAS, vol. 96, pp. 6745-6750 (1999).
Bittner, M. et al., "Molecular classification of cutaneous malignant melanoma by gene expression profiling", Nature, vol. 406, pp. 536-540 (2000).
Blanchard, A. et al., "Sequence to array: Probing the genome's secrets", Nature Biotechnology, vol. 14, p. 1649 (1996).
Cockett, M. et al., "Applied genomics: integration of the technology within pharmaceutical research and development", Current Opinion in Biotechnology, vol. 11, pp. 602-609 (2000).
Fry, D. et al., "A Specific Inhibitor of the Epidermal Growth Factor Receptor Tyrosine Kinase", Science, vol. 265, pp. 1093-1095 (1994).
Glinsky, G. et al., "Gene expression profiling predicts clinical outcome of prostate cancer", The J. of Clinical Investigation, vol. 113(6), pp. 913-923 (2004).
Golub, T.R. et al., "Molecular Classification of Cancer: Class Discovery and Class Prediction by Gene Expression Monitoring", Science, vol. 286, pp. 531-537 (1999).
Khan, J. et al., "Classification and diagnostic prediction of cancers using gene expression profiling and artificial neural networks", Nature Medicine, vol. 7(6), pp. 673-679 (2001).
Khan, J. et al., "Gene Expression Profiling of Alveolar Rhabdomyosarcoma with cDNA Microarrays", Cancer Research, vol. 58, pp. 5009-5013 (1998).
Lockhart, D. et al., "Expression monitoring by hybridization to high-density oligonucleotide arrays", Nature Biotechnology, vol. 14, pp. 1675-1680 (1996).
Miller, A.B., et al., "Reporting Results of Cancer Treatment", Cancer, vol. 47, pp. 207-214 (1981).
Panek, R. et al., "In Vitro Pharmacological Characterization of PD 166285, a New Nanomolar Potent and Broadly Active Protein Tyrosine Kinase Inhibitor", The J. of Pharmacology and Experimental Therapeutics, vol. 283(3), pp. 1433-1444 (1997).
Schena, M. et al., "Quantitative Monitoring of Gene Expression Patterns with a Complementary DNA Microarray", Science, vol. 270, pp. 467-470 (1995).
Shipp, M. et al., "Diffuse large B-cell lymphoma outcome prediction by gene-expression profiling and supervised machine learning", Nature Medicine, vol. 8(1), pp. 68-74 (2002).
Sonneveld, P., "Multidrug resistance in haematological malignancies", Journal of Internal Medicine, vol. 247, pp. 521-534 (2000).
Sørlie, T. et al., "Gene expression patterns of breast carcinomas distinguish tumor subclasses with clinical implications", PNAS, vol. 98(19), pp. 10869-10874 (2001).
Van't Veer, L. et al., "Gene expression profiling predicts clinical outcome of breast cancer", Nature, vol. 415, pp. 530-536 (2002).

(Continued)

*Primary Examiner* — Misook Yu
*Assistant Examiner* — Lei Yao
(74) *Attorney, Agent, or Firm* — Stephen C. D'Amico; Paul D. Golian

(57) ABSTRACT

EGFR biomarkers useful in a method for predicting the likelihood that a mammal that will respond therapeutically to a method of treating cancer comprising administering an EGFR modulator, wherein the method comprises (a) measuring in the mammal the level of at least one biomarker selected from epiregulin and amphiregulin, (b) exposing a biological sample from the mammal to the EGFR modulator, and (c) following the exposing of step (b), measuring in the biological sample the level of the at least one biomarker, wherein an increase in the level of the at least one biomarker measured in step (c) compared to the level of the at least one biomarker measured in step (a) indicates an increased likelihood that the mammal will respond therapeutically to the method of treating cancer.

14 Claims, 12 Drawing Sheets

U.S. PATENT DOCUMENTS

| | | | |
|---|---|---|---|
| 4,943,533 | A | 7/1990 | Mendelsohn et al. |
| 5,196,446 | A | 3/1993 | Levitzki et al. |
| 5,558,864 | A | 9/1996 | Bendig et al. |
| 5,569,588 | A | 10/1996 | Ashby et al. |
| 5,591,582 | A | 1/1997 | Bos et al. |
| 5,616,582 | A | 4/1997 | Barker |
| 5,646,153 | A | 7/1997 | Spada et al. |
| 5,656,655 | A | 8/1997 | Spada et al. |
| 5,679,683 | A | 10/1997 | Bridges et al. |
| 5,847,095 | A | 12/1998 | Bos et al. |
| 5,891,996 | A | 4/1999 | Mateo de Acosta del Rio et al. |
| 6,156,504 | A | 12/2000 | Gocke et al. |
| 6,235,883 | B1 | 5/2001 | Jakobovits et al. |
| 6,503,914 | B1 | 1/2003 | Benish et al. |
| 6,713,619 | B1 | 3/2004 | Weinberg et al. |
| 7,387,874 | B2 | 6/2008 | Gocke et al. |
| 7,858,389 | B2 | 12/2010 | Roder et al. |
| 2002/0004587 | A1 | 1/2002 | Miller et al. |
| 2003/0225528 | A1 | 12/2003 | Baker et al. |
| 2004/0006212 | A1 | 1/2004 | Goldstein et al. |
| 2004/0157255 | A1 | 8/2004 | Agus et al. |
| 2004/0191817 | A1 | 9/2004 | Scott et al. |
| 2004/0209290 | A1 | 10/2004 | Cobleigh et al. |
| 2005/0019785 | A1 | 1/2005 | Baker et al. |
| 2005/0272083 | A1* | 12/2005 | Seshagiri ......................... 435/6 |
| 2006/0121044 | A1 | 6/2006 | Amler et al. |
| 2006/0204505 | A1 | 9/2006 | Sliwkowski et al. |
| 2006/0252056 | A1 | 11/2006 | Tsuruo et al. |
| 2007/0037228 | A1 | 2/2007 | Moecks et al. |
| 2007/0065845 | A1 | 3/2007 | Baker et al. |
| 2007/0141589 | A1 | 6/2007 | Baker et al. |
| 2007/0254295 | A1 | 11/2007 | Harvey et al. |
| 2008/0057501 | A1 | 3/2008 | Gocke et al. |
| 2008/0176229 | A1 | 7/2008 | Agus et al. |
| 2008/0182255 | A1 | 7/2008 | Baker et al. |
| 2008/0293055 | A1 | 11/2008 | Freeman et al. |
| 2008/0317753 | A1 | 12/2008 | Amler et al. |
| 2009/0075267 | A1 | 3/2009 | Siena et al. |
| 2009/0202989 | A1* | 8/2009 | Hillan ............................. 435/6 |
| 2010/1005510 | | 3/2010 | Roder et al. |

FOREIGN PATENT DOCUMENTS

| | | |
|---|---|---|
| WO | WO9630347 | 10/1996 |
| WO | WO9633980 | 10/1996 |
| WO | WO9727199 | 7/1997 |
| WO | WO9730034 | 8/1997 |
| WO | WO9742187 | 11/1997 |
| WO | WO9749688 | 12/1997 |
| WO | WO9833798 | 8/1998 |
| WO | WO0018761 | 4/2000 |
| WO | WO0031048 | 6/2000 |
| WO | WO2004/063709 A2 | 7/2004 |
| WO | WO2005049829 A1 | 6/2005 |
| WO | WO2005/067667 A2 | 7/2005 |
| WO | WO2005067667 A2 | 7/2005 |
| WO | WO2005094332 A2 | 10/2005 |
| WO | WO2005118876 A2 | 12/2005 |

OTHER PUBLICATIONS

Wands, J. et al., "High Affinity monoclonal Antibodies to Hepatitis B Surface Antigen (HB$_8$Ag) Produced by Somatic Cell Hybrids", Gastroenterology, vol. 80, pp. 225-232 (1981).

Kato, et al., "Oncogenic Ras Modulates Epidermal Growth Factor Responsiveness in Endometrial Carcinomas", European J. Cancer, vol. 34 (5), pp. 737-744 (1998).

Office communication from USPTO dated Nov. 23, 2009, U.S. Appl. No. 12/046,319, filed Mar. 11, 2008; First Named Inventor—Daniel Freeman.

Almoguera, et al., "Most Human Carcinomas of the Exocrine Pancreas Contain Mutant c-K-ras Genes", Cell, vol. 53, pp. 549-554 (1988).

Banerjea, et al., "Colorectal cancers with microsatellite instability display mRNA expression signatures characteristic of increased immunogenicity", Molec. Cancer, vol. 3 (21) (2004).

Baselga, et al., "Critical Update and Emerging Trends in Epidermal Growth Factor Receptor Targeting in Cancer", J. Clin. Oncol., vol. 23 (11), pp. 2445-2459 (2005).

Bonner, et al., "Radiotherapy plus Cetuximab for Squamous-Cell Carcinoma of the Head and Neck", New Eng. J. Med., vol. 354, pp. 567-578 (2006).

Boulalas, et al., "Activation of RAS Family Genes in Urothelial Carcinoma", J. Urology, vol. 181, pp. 2312-2319 (2009).

Britton, et al., "Bidirectional cross talk between ERα and EGFR signaling pathways regulates tamoxifen-resistant growth", Breast Cancer Res. Treatment, vol. 96, pp. 131-146 (2006).

Cappuzzo, et al., "Epidermal Growth Factor Receptor Gene and Protein and Gefitinib Sensitivity in Non-Small-Cell Lung Cancer", J. National Cancer Institute, vol. 97 (9), p. 643-655 (2005).

Chen, et al., "Intronic Alterations in BRCA1 and BRCA2: Effect on mRNA Splicing Fidelity and Expression", Human Mutation, vol. 27 (5), pp. 427-435 (2006).

Chung, et al., "Cetuximab Shows Activity in Colorectal Cancer Patients With Tumors That Do Not Express the Epidermal Growth Factor Receptor by Immunohistochemistry", J. Clin. Oncol., vol. 23 (9), pp. 1803-1810 (2005).

Ciardiello, et al., "Epidermal growth factor receptor (EGFR) as a target in cancer therapy: understanding the role of receptor expression and other molecular determinants that could influence the response to anti-EGFR drugs", Eur. J. Cancer, vol. 39, pp. 1348-1354 (2003).

Ciardiello, et al., "Phase II study of gefitinib in combination with docetaxel as first-line therapy in metastatic breast cancer", British J. Cancer, vol. 94, pp. 1604-1609 (2006).

Conti, et al., "Role of the Epidermal Growth Factor Network in Ovarian Follicles", Molec. Endocrinology, vol. 20 (4), pp. 715-723 (2006).

Crous-Bou, et al., "Lifetime History of Alcohol Consumption and K-ras Mutations in Pancreatic Ductal Adenocarcinoma", Environmental Molec. Mutagenesis, In Press (2009).

Cunningham, et al., "Cetuximab Monotherapy and Cetuximab plus Irinotecan in Ironotecan-Refractory Metastatic Colorectal Cancer", New Eng. J. Med., vol. 351, pp. 337-345 (2004).

Deng, et al., "Activated c-Ha-ras Oncogene with a Guanine to Thymine Transversion at the Twelfth Codon in a Human Stomach Cancer Cell Line", Cancer Res., vol. 47, pp. 3195-3198 (1987).

Eroglu, et al., "Activities of adenosine deaminase and 5'-nucleotidase in cancerous and noncancerous human colorectal tissues", Medical Oncol., vol. 17, pp. 319-324 (2000).

Fontanini, et al., "Evaluation of Epidermal Growth Factor-related Growth Factors and Receptors and of Neoangiogenesis in Completely Resected Stage I-IIIA Non-Small-Cell Lung Cancer: Amphiregulin and Microvessel Count Are Independent Prognostic Indicators of Survival", Clin. Cancer Res., vol. 4, pp. 241-249 (1998).

Freimann, et al., "Drug development for ovarian hyper-stimulation and anti-cancer treatment: blocking of gonadotropin signaling for epiregulin and amphiregulin biosynthesis", Biochem. Pharmacology, vol. 68, pp. 989-996 (2004).

Fujimoto, et al., "High Expression of ErbB Family Members and Their Ligands in Lung Adenocarcinomas That are Sensitive to Inhibition of Epidermal Growth Factor Receptor", Cancer Res., vol. 65 (24), pp. 11478-11485 (2005).

Giovannetti, et al., "Transcription Analysis of Human Equilibrative Nucleoside Transporter-1 Predicts Survival in Pancreas Cancer Patients Treated with Gemcitabine", Cancer Res., vol. 66 (7), pp. 3928-3935 (2006).

Grimmond, et al., "Detection of a rare point mutation in Ki-ras of a human bladder cancer xenograft by polymerase chain reaction and direct sequencing", Urol. Res., vol. 20, pp. 121-126 (1992).

Haritani, et al., "Oncogene Expression in the Liver Tissue of Patients with Nonneoplastic Liver Disease", Cancer, vol. 67, pp. 2594-2598 (1991).

Ishikawa, et al., "Increases of Amphiregulin and Transforming Growth Factor-α in Serum as Predictors of Poor Response to Gefitinib among Patients with Advanced Non-Small Cell Lung Cancers", Cancer Res., vol. 65 (20), pp. 9176-9184 (2005).

Janne, et al., "Epidermal Growth Factor Receptor Mutations in Non-Small-Cell Lung Cancer: Implications for Treatment and Tumor Biology", J. Clin. Oncology, vol. 23 (14), pp. 3227-3234 (2005).

Lenz, et al., "Activity of cetuximab in patients with colorectal cancer refractory to both irinotecan and oxaliplatin", 2004 ASCO Annual Meeting, Abstract 3510.

Lenz, et al., "Activity of cetuximab in patients with colorectal cancer refractory to both irinotecan and oxaliplatin", J. Clin. Oncology, vol. 22, No. 14S (Jul. 15 Supplement) 2004: 3510.

Lenz, et al., "KRAS mutation in metastatic colorectal cancer and its impact on the use of EGFR inhibitors", Clin. Adv. Hematol. Oncol., vol. 6 (12), pp. 1-13 (2008).

Lievre, et al., "KRAS Mutation Status is Predictive of Response to Cetuximab Therapy in Colorectal Cancer", Cancer Res., vol. 66 (8), pp. 3992-3995 (2006).

Lynch, et al "Activating Mutations in the Epidermal Growth Factor Receptor Underlying Responsiveness of Non-Small-Cell Lung Cancer to Gefitinib", New Eng. J. Med., vol. 350 (21), pp. 2129-2139 (2004).

Mahtouk, et al., "Expression of EGF-family receptors and amphiregulin in multiple myeloma. Amphiregulin is a growth factor for myeloma cells", HAL Archives Ouvertes—France, Author Manuscript (Published in final edited form as Oncogene, May 2005; 24(21):3512-3524).

Mahtouk, et al., "Expression of EGF-family receptors and amphiregulin in multiple myeloma. Amphiregulin is a growth factor for myeloma cells", Oncogene, vol. 24, pp. 3512-3524 (2005).

Mellinghoff, et al., "Molecular Determinants of the Response of Gliblastomas to EGFR Kinase Inhibitors", N. Eng. J. Med., vol. 353, pp. 2012-2024 (2005).

Minamoto, et al., "K-ras Mutation: Early Detection in Molecular Diagnosis and Risk Assessment of Colorectal, Pancreas, and Lung Cancers—A Review", Cancer Detection Prev., vol. 24(1), pp. 1-12 (2000).

Moroni, et al., "Gene copy number for epidermal growth factor receptor (EGFR) and clinical response to antiEGFR treatment in colorectal cancer: a cohort study", Lancet Oncol., vol. 6, pp. 279-286 (2005).

Normanno, et al., "Epidermal growth factor receptor (EGFR) signaling in cancer", Gene, vol. 366, pp. 2-16 (2006).

Osherov, et al., "Selective Inhibition of the Epidermal Growth Factor and HER2/Neu Receptors by Tyrphostins", J. Biol. Chem., vol. 268 (15), pp. 11134-11142 (1993).

Pao, et al., "KRAS Mutations and Primary Resistance of Lung Adenocarcinomas to Gefitinib or Erlotinib", PLoS Med., vol. 2(1), pp. 0057-0061 (2005).

Saltz, et al., "Phase II Trial of Cetuximab in Patients With Refractory Colorectal Cancer That Expresses the Epidermal Growth Factor Receptor", J. Clin. Oncology, vol. 22 (7), pp. 1201-1208 (2004).

Schilder, et al., "Phase II Study of Gefitinib in Patients with Relapsed or Persistent Ovarian or Primary Peritoneal Carcinoma and Evaluation of Epidermal Growth Factor Receptor Mutations and Immunohistochemical Expression: A Gynecologic Oncology Group Study", Clin. Can. Res., vol. 11 (15), pp. 5539-5548 (2005).

Shelly, et al., "Epiregulin is a Potent Pan-ErbB Ligand That Preferentially Activates Heterodimeric Receptor Complexes", J. Biol. Chem., vol. 272 (17), pp. 10496-10505 (1998).

Slebos, et al., "Allele-Specific Detection of K-ras Oncogene Expression in Human Non-Small-Cell Lung Carcinomas", Int. J. Cancer, vol. 48, pp. 51-56 (1991).

Thogersen, et al., "A Subclass of HER1 Ligands are Prognostic Markers for Survival in Bladder Cancer Patients", Cancer Res., vol. 61, pp. 6227-6233 (2001).

Torring, et al., "Increased Expression of Heparin Binding EGF (HB-EGF), Amphiregulin, TGFα and Epiregulin in Androgen-Independent Prostate Cancer Cell Lines", Anticancer Res., vol. 20, pp. 91-96 (2000).

Torring, et al., "Increase in Amphiregulin and Epiregulin in Prostate Cancer Xenograft After Androgen Deprivation-Impact of specific HER1 Inhibition", The Prostate, vol. 64, pp. 1-8 (2005).

Tsuchihashi, et al., "Responsiveness to Cetuximab without Mutations in EGFR", N. Engl. J. Med., vol. 353, pp. 208-209 (2005).

Tsao, et al., "Erlotinib in Lung Cancer—Molecular and Clinical Predictors of Outcome", N. Engl. J. Med., vol. 353, pp. 133-144 (2005).

Cutsem, et al., "Cetuximab and Chemotherapy as Initial Treatment for Metastatic Colorectal Cancer", N. Eng. J. Med., vol. 360, pp. 1408-1417 (2009).

Zavodna, et al., "Genetic analysis of KRAS mutation status in metastatic colorectal cancer patients", Neoplasma, vol. 56 (3), pp. 275-278 (2009).

Zhu, et al., "Epiregulin is Up-Regulated in Pancreatic Cancer and Stimulates Pancreatic Cancer Cell Growth", Biochem. Biophysical Res. Comm., vol. 273, pp. 1019-1024 (2000).

NCBI Entrez Accession No. NP_203524 (gi:15718763), Boulalas, et al., Apr. 26, 2009.

NCBI Entrez Accession No. NP_004976 (gi:15718761), Boulalas, et al., Apr. 26, 2009.

NCBI Entrez Accession No. NM_004985 (gi:34485723), Boulalas, et al., Apr. 26, 2009.

NCBI Entrez Accession No. NM_033360 (gi:34485724), Boulalas, et al., Apr. 26, 2009, Nov. 12, 2010.

Khambata-Ford, et al., "Expression of Epiregulin and Amphiregulin and K-ras Mutation Status Predict Disease Control in Metastatic Colorectal Cancer Patients Treated With Cetuximab", J. Clin. Oncology, vol. 25 (22), pp. 3230-3237 (2007).

Alekshun, et al., "Targeted Therapies in the Treatment of Colorectal Cancers", Cancer Control, vol. 12 (2), pp. 105-110 (2005).

Cohen, et al., "Epidermal Growth Factor Receptor as a Therapeutic Target in Colorectal Cancer", Clinical Colorectal Cancer, vol. 2 (4), pp. 246-251 (2003).

Morton, et al., "ASCO Provisional Clinical Opinion: KRAS, Cetuximab, and Panitumumab—Clinical Implications in Colorectal Cancer", J Oncology Practice, vol. 5 (2), pp. 71-72 (2009).

* cited by examiner

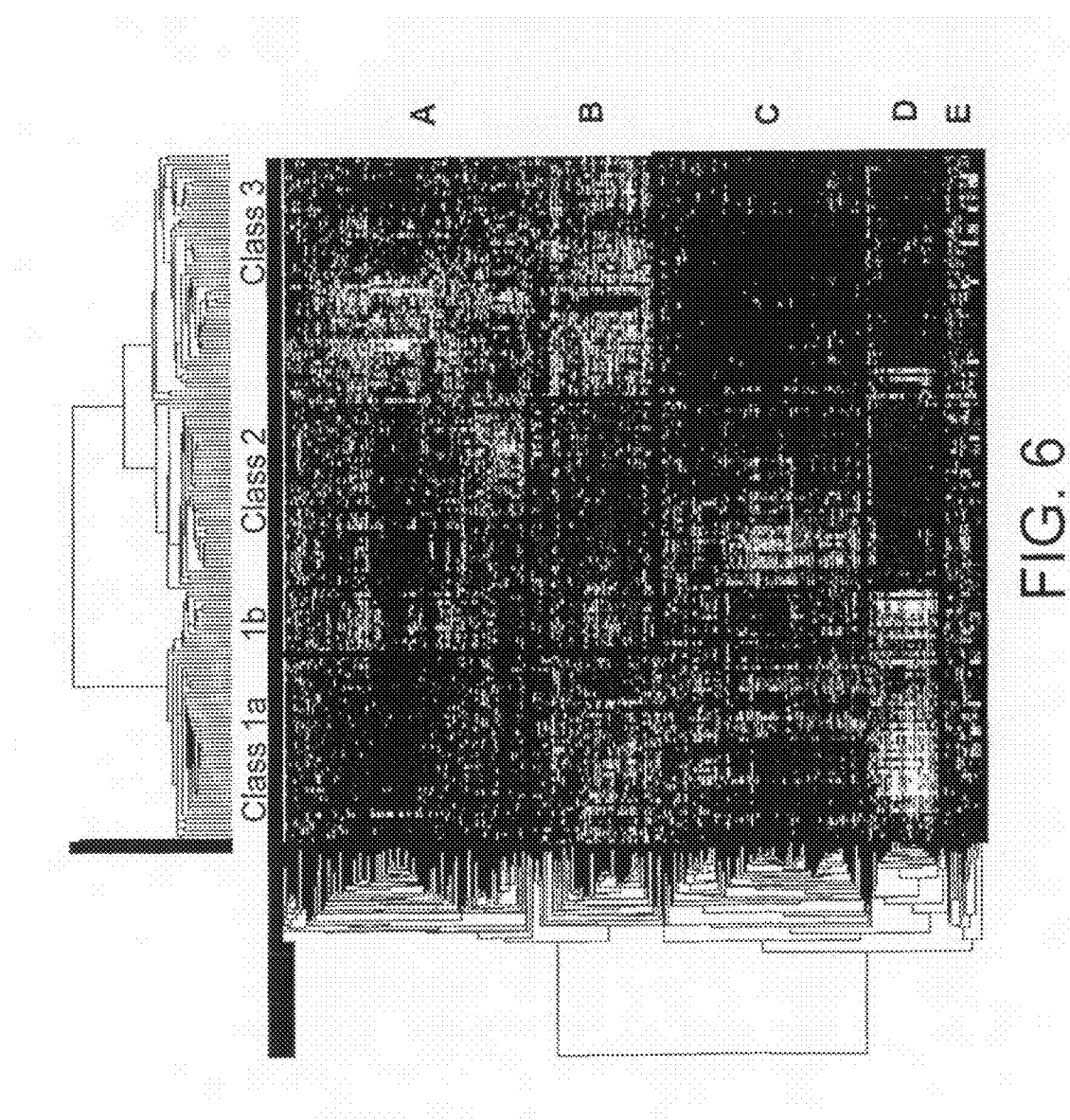

BIOMARKERS AND METHODS FOR DETERMINING SENSITIVITY TO EPIDERMAL GROWTH FACTOR RECEPTOR MODULATORS

This application claims benefit to International Application No. PCT/US2006/033073, filed Aug. 24, 2006, under 35 U.S.C. §365(a); which claims priority to provisional application U.S. Ser. No. 60/711,054, filed Aug. 24, 2005; under 35 U.S.C. §119(e). The entire teachings of the referenced applications are incorporated herein by reference.

SEQUENCE LISTING

A compact disc labeled "Copy 1" contains the Sequence Listing as 10646 PCT.ST25.txt. The Sequence Listing is 1241 KB in size and was recorded Aug. 24, 2006. The compact disk is 1 of 2 compact disks. A duplicate copy of the compact disc is labeled "Copy 2" and is 2 of 2 compact discs.

The compact disc and duplicate copy are identical and are hereby incorporated by reference into the present application.

FIELD OF THE INVENTION

The present invention relates generally to the field of pharmacogenomics, and more specifically to methods and procedures to determine drug sensitivity in patients to allow the identification of individualized genetic profiles which will aid in treating diseases and disorders.

BACKGROUND OF THE INVENTION

Cancer is a disease with extensive histoclinical heterogeneity. Although conventional histological and clinical features have been correlated to prognosis, the same apparent prognostic type of tumors varies widely in its responsiveness to therapy and consequent survival of the patient.

New prognostic and predictive markers, which would facilitate an individualization of therapy for each patient, are needed to accurately predict patient response to treatments, such as small molecule or biological molecule drugs, in the clinic. The problem may be solved by the identification of new parameters that could better predict the patient's sensitivity to treatment. The classification of patient samples is a crucial aspect of cancer diagnosis and treatment. The association of a patient's response to a treatment with molecular and genetic markers can open up new opportunities for treatment development in non-responding patients, or distinguish a treatment's indication among other treatment choices because of higher confidence in the efficacy. Further, the pre-selection of patients who are likely to respond well to a medicine, drug, or combination therapy may reduce the number of patients needed in a clinical study or accelerate the time needed to complete a clinical development program (Cockett et al., Current Opinion in Biotechnology, 11:602-609 (2000)).

The ability to predict drug sensitivity in patients is particularly challenging because drug responses reflect not only properties intrinsic to the target cells, but also a host's metabolic properties. Efforts to use genetic information to predict drug sensitivity have primarily focused on individual genes that have broad effects, such as the multidrug resistance genes, mdr1 and mrp1 (Sonneveld, J. Intern. Med., 247:521-534 (2000)).

The development of microarray technologies for large scale characterization of gene mRNA expression pattern has made it possible to systematically search for molecular markers and to categorize cancers into distinct subgroups not evident by traditional histopathological methods (Khan et al., Cancer Res., 58:5009-5013 (1998); Alizadeh et al., Nature, 403:503-511 (2000); Bittner et al., Nature, 406:536-540 (2000); Khan et al., Nature Medicine, 7(6):673-679 (2001); and Golub et al., Science, 286:531-537 (1999); Alon et al., P. N. A. S. USA, 96:6745-6750 (1999)). Such technologies and molecular tools have made it possible to monitor the expression level of a large number of transcripts within a cell population at any given time (see, e.g., Schena et al., Science, 270:467-470 (1995); Lockhart et al., Nature Biotechnology, 14:1675-1680 (1996); Blanchard et al., Nature Biotechnology, 14:1649 (1996); U.S. Pat. No. 5,569,588).

Recent studies demonstrate that gene expression information generated by microarray analysis of human tumors can predict clinical outcome (van't Veer et al., Nature, 415:530-536 (2002); Sorlie et al., P. N. A. S. USA, 98:10869-10874 (2001); M. Shipp et al., Nature Medicine, 8(1):68-74 (2002): Glinsky et al., The Journal of Clin. Invest., 113(6):913-923 (2004)). These findings bring hope that cancer treatment will be vastly improved by better predicting the response of individual tumors to therapy.

The epidermal growth factor receptor (EGFR) and its downstream signaling effectors, notably members of the Ras/Raf/MAP kinase pathway, play an important role in both normal and malignant epithelial cell biology (Normanno et al., Gene 366, 2-16 (2006)) and have therefore become established targets for therapeutic development. Whereas the anti-EGFR antibody cetuximab and the EGFR small molecular tyrosine kinase inhibitors (TKIs) gefitinib and erlotinib have demonstrated activity in a subset of patients (Baselga and Arteaga, J. Clin. Oncol. 23, 2445-2459 (2005)), their initial clinical development has not benefited from an accompanying strategy for identifying the patient populations that would most likely derive benefit. The hypothesis that only a relatively small number of tumors are "EGFR-pathway dependent" and therefore likely to respond to EGFR inhibitors might explain the limited clinical activity that is observed with this class of therapeutics. For example, in patients with refractory metastatic colorectal cancer clinical response rates with cetuximab consistently range from 11% in a monotherapy setting to 23% in a combination setting with chemotherapy (Cunningham et al., N. Engl. J. Med 351, 337-345 (2004)). To date, significant efforts have been focused on elucidating the mechanisms of sensitivity or resistance to EGFR inhibition, particularly through evaluation of EGFR protein expression, kinase domain mutations, and gene copy number.

While relative protein expression of the EGFR as measured by immunohistochemistry (IHC) has been demonstrated in many solid tumors (Ciardiello and Tortora, Eur. J. Cancer 39, 1348-1354 (2003)), no consistent association between EGFR expression and response to EGFR inhibitors has been established. Clinical studies of cetuximab in a monotherapy setting and in combination with irinotecan in patients with mCRC failed to reveal an association between radiographic response and EGFR protein expression as measured by IHC (Cunningham et al., N. Engl. J. Med 351, 337-345 (2004); Saltz et al., J. Clin. Oncol. 22, 1201-1208 (2004)). Furthermore, clinical responses have been demonstrated in patients with undetectable EGFR protein expression (Chung et al., J. Clin. Oncol., 23, 1803-1810 (2005); Lenz et al., Activity of cetuximab in patients with colorectal cancer refractory to both irinotecan and oxaliplatin. Paper presented at: 2004 ASCO Annual Meeting Proceedings; Saltz, Clin Colorectal Cancer, 5 Suppl. 2, S98-100 (2005)). In comparison, clinical studies of erlotinib in NSCLC patients and gefitinib in ovarian cancer did demonstrate an association between EGFR expression, response, and survival (Schilder et al., Clin. Cancer Res., 11, 5539-5548 (2005); Tsao et al., N. Engl. J. Med., 353, 133-144 (2005)). The presence of somatic mutations in the tyrosine kinase domain, particularly in NSCLC has been extensively described (Janne et al., J. Clin. Oncol., 23, 3227-3234 (2005)). In both preclinical and clinical settings, these mutations are found to correlate with sensitivity to gefitinib and erlotinib but not to cetuximab (Janne et al., J. Clin. Oncol., 23, 3227-3234 (2005); Tsuchihashi et al., N. Engl. J. Med., 353, 208-209 (2005)). In addition, the lack of EGFR kinase domain mutations in CRC patients suggests that such mutations do not underlie the response to cetuximab. EGFR gene copy number has also been evaluated as a potential predictor of response to EGFR inhibitors. Clinical studies of gefitinib demonstrated an association between increased EGFR copy number, mutational status, and clinical response (Cappuzzo et al., J. Natl. Cancer Inst., 97, 643-655 (2005)). A similar association was identified in a small number of patients treated with the anti-EGFR monoclonal antibodies cetuximab and panitumumab (Moroni et al., Lancet Oncol., 6, 279-286 (2005)). Additional potential predictive biomarkers have also been evaluated. For example, in glioblastoma patients, a significant association between co-expression of EGFRvIII and PTEN and response to EGFR small molecule inhibitors was found (Mellinghoff et al., N. Engl. J. Med., 353, 2012-2024 (2005)).

The anti-tumor activity of cetuximab has been attributed to its ability to block EGFR ligand binding and ligand-dependent EGFR activation. Clinical activity of cetuximab has been shown in multiple epithelial tumor types (Bonner et al., N. Engl. J. Med., 354, 567-578 (2006); Cunningham et al., N. Engl. J. Med., 351, 337-345 (2004)), however responses continue to be seen in only a fraction of patients. Previous attempts to identify predictors of sensitivity or resistance as described above have focused on specific biomarkers rather than using genomic discovery approaches. In addition, RNA-, DNA- and protein-based markers have rarely been examined in the same patient population in a single study, making comparisons challenging.

Biomarkers useful for determining sensitivity to EGFR modulators have been described in published PCT applications WO2004/063709, WO2005/067667, and WO2005/094332.

Needed are new and alternative methods and procedures to determine drug sensitivity in patients to allow the development of individualized genetic profiles which are necessary to treat diseases and disorders based on patient response at a molecular level.

SUMMARY OF THE INVENTION

The invention provides methods and procedures for determining patient sensitivity to one or more Epidermal Growth Factor Receptor (EGFR) modulators. The invention also provides methods of determining or predicting whether an individual requiring therapy for a disease state such as cancer will or will not respond to treatment, prior to administration of the treatment, wherein the treatment comprises administration of one or more EGFR modulators. The one or more EGFR modulators are compounds that can be selected from, for example, one or more EGFR-specific ligands, one or more small molecule EGFR inhibitors, or one or more EGFR binding monoclonal antibodies.

In one aspect, the invention provides a method for predicting the likelihood a mammal will respond therapeutically to a method of treating cancer comprising administering an EGFR modulator, wherein the method comprises: (a) measuring in the mammal the level of at least one biomarker selected from epiregulin and amphiregulin; (b) exposing a biological sample from the mammal to the EGFR modulator; (c) following the exposing of step (b), measuring in the biological sample the level of the at least one biomarker, wherein an increase in the level of the at least one biomarker measured in step (c) compared to the level of the at least one biomarker measured in step (a) indicates an increased likelihood that the mammal will respond therapeutically to the method of treating cancer. In one aspect, the at least one biomarker comprises epiregulin and amphiregulin. In yet another aspect, the at least one biomarker further comprises at least one additional biomarker selected from Table 1. In another aspect, the biological sample is a tissue sample comprising cancer cells and the method further comprises the step of determining whether the cancer cells have the presence of a mutated K-RAS, wherein detection of a mutated K-RAS indicates a decreased likelihood that that the mammal will respond therapeutically to the method of treating cancer.

The biological sample can be, for example, a tissue sample comprising cancer cells and the tissue is fixed, paraffin-embedded, fresh, or frozen.

In another aspect, the EGFR modulator is cetuximab and the cancer is colorectal cancer.

In another aspect, the invention is a method for predicting the likelihood a mammal will respond therapeutically to a method of treating cancer comprising administering an EGFR modulator, wherein the method comprises: (a) measuring in the mammal the level of at least one biomarker that comprises CD73; (b) exposing a biological sample from the mammal to the EGFR modulator; (c) following the exposing of step (b), measuring in the biological sample the level of the at least one biomarker, wherein an increase in the level of the at least one biomarker measured in step (c) compared to the level of the at least one biomarker measured in step (a) indicates a decreased likelihood that the mammal will respond therapeutically to the method of treating cancer. In another aspect, the at least one biomarker further comprises at least one additional biomarker selected from Table 1. In another aspect, the method further comprises the step of determining whether the cancer cells have the presence of a mutated K-RAS, wherein detection of a mutated K-RAS indicates a decreased likelihood that that the mammal will respond therapeutically to the method of treating cancer.

A difference in the level of the biomarker that is sufficient to predict the likelihood that the mammal will or will not respond therapeutically to the method of treating cancer can be readily determined by one of skill in the art using known techniques. The increase or decrease in the level of the biomarker can be correlated to determine whether the difference is sufficient to predict the likelihood that a mammal will respond therapeutically. The difference in the level of the biomarker that is sufficient can, in one aspect, be predetermined prior to predicting the likelihood that the mammal will respond therapeutically to the treatment. In one aspect, the difference in the level of the biomarker is a difference in the mRNA level (measured, for example, by RT-PCR or a microarray), such as at least a two-fold difference, at least a three-fold difference, or at least a four-fold difference in the level of expression. In another aspect, the difference in the level of the biomarker is determined by IHC. In another aspect, the difference in the level of the biomarker refers to a p-value of <0.05 in Anova (t test) analysis. In yet another aspect, the difference is determined in an ELISA assay.

As used herein, respond therapeutically refers to the alleviation or abrogation of the cancer. This means that the life expectancy of an individual affected with the cancer will be increased or that one or more of the symptoms of the cancer will be reduced or ameliorated. The term encompasses a reduction in cancerous cell growth or tumor volume. Whether a mammal responds therapeutically can be measured by many methods well known in the art, such as PET imaging.

The mammal can be, for example, a human, rat, mouse, dog, rabbit, pig sheep, cow, horse, cat, primate, or monkey.

The method of the invention can be, for example, an in vitro method wherein the step of measuring in the mammal the level of at least one biomarker comprises taking a biological sample from the mammal and then measuring the level of the biomarker(s) in the biological sample. The biological sample can comprise, for example, at least one of serum, whole fresh blood, peripheral blood mononuclear cells, frozen whole blood, fresh plasma, frozen plasma, urine, saliva, skin, hair follicle, bone marrow, or tumor tissue.

The level of the at least one biomarker can be, for example, the level of protein and/or mRNA transcript of the biomarker. The level of the biomarker can be determined, for example, by RT-PCR or another PCR-based method, immunohistochemistry, proteomics techniques, or any other methods known in the art, or their combination.

In another aspect, the invention provides a method for identifying a mammal that will respond therapeutically to a method of treating cancer comprising administering of an EGFR modulator, wherein the method comprises: (a) measuring in the mammal the level of at least one biomarker selected from the biomarkers of Table 1; (b) exposing a biological sample from the mammal to the EGFR modulator; (c) following the exposing in step (b), measuring in said biological sample the level of the at least one biomarker, wherein a difference in the level of the at least one biomarker measured in step (c) compared to the level of the at least one biomarker measured in step (a) indicates that the mammal will respond therapeutically to the said method of treating cancer.

In another aspect, the invention provides a method for identifying a mammal that will respond therapeutically to a method of treating cancer comprising administering an EGFR modulator, wherein the method comprises: (a) exposing a biological sample from the mammal to the EGFR modulator; (b) following the exposing of step (a), measuring in said biological sample the level of at least one biomarker selected from the biomarkers of Table 1, wherein a difference in the level of the at least one biomarker measured in step (b), compared to the level of the at least one biomarker in a mammal that has not been exposed to said EGFR modulator, indicates that the mammal will respond therapeutically to said method of treating cancer.

In yet another aspect, the invention provides a method for testing or predicting whether a mammal will respond therapeutically to a method of treating cancer comprising administering an EGFR modulator, wherein the method comprises: (a) measuring in the mammal the level of at least one biomarker selected from the biomarkers of Table 1; (b) exposing the mammal to the EGFR modulator; (c) following the exposing of step (b), measuring in the mammal the level of the at least one biomarker, wherein a difference in the level of the at least one biomarker measured in step (c) compared to the level of the at least one biomarker measured in step (a) indicates that the mammal will respond therapeutically to said method of treating cancer.

In another aspect, the invention provides a method for determining whether a compound inhibits EGFR activity in a mammal, comprising: (a) exposing the mammal to the compound; and (b) following the exposing of step (a), measuring in the mammal the level of at least one biomarker selected from the biomarkers of Table 1, wherein a difference in the level of said biomarker measured in step (b), compared to the level of the biomarker in a mammal that has not been exposed to said compound, indicates that the compound inhibits EGFR activity in the mammal.

In yet another aspect, the invention provides a method for determining whether a mammal has been exposed to a compound that inhibits EGFR activity, comprising (a) exposing the mammal to the compound; and (b) following the exposing of step (a), measuring in the mammal the level of at least one biomarker selected from the biomarkers of Table 1, wherein a difference in the level of said biomarker measured in step (b), compared to the level of the biomarker in a mammal that has not been exposed to said compound, indicates that the mammal has been exposed to a compound that inhibits EGFR activity.

In another aspect, the invention provides a method for determining whether a mammal is responding to a compound that inhibits EGFR activity, comprising (a) exposing the mammal to the compound; and (b) following the exposing of step (a), measuring in the mammal the level of at least one biomarker selected from the biomarkers of Table 1, wherein a difference in the level of the at least one biomarker measured in step (b), compared to the level of the at least one biomarker in a mammal that has not been exposed to said compound, indicates that the mammal is responding to the compound that inhibits EGFR activity.

As used herein, "responding" encompasses responding by way of a biological and cellular response, as well as a clinical response (such as improved symptoms, a therapeutic effect, or an adverse event), in a mammal.

The invention also provides an isolated biomarker selected from the biomarkers of Table 1. The biomarkers of the invention comprise sequences selected from the nucleotide and amino acid sequences provided in Table 1 and the Sequence Listing, as well as fragments and variants thereof.

The invention also provides a biomarker set comprising two or more biomarkers selected from the biomarkers of Table 1.

The invention also provides kits for determining or predicting whether a patient would be susceptible or resistant to a treatment that comprises one or more EGFR modulators. The patient may have a cancer or tumor such as, for example, colorectal cancer, NSCLC, or head and neck cancer.

In one aspect, the kit comprises a suitable container that comprises one or more specialized microarrays of the invention, one or more EGFR modulators for use in testing cells from patient tissue specimens or patient samples, and instructions for use. The kit may further comprise reagents or materials for monitoring the expression of a biomarker set at the level of mRNA or protein.

In another aspect, the invention provides a kit comprising two or more biomarkers selected from the biomarkers of Table 1.

In yet another aspect, the invention provides a kit comprising at least one of an antibody and a nucleic acid for detecting the presence of at least one of the biomarkers selected from the biomarkers of Table 1. In one aspect, the kit further comprises instructions for determining whether or not a mammal will respond therapeutically to a method of treating cancer comprising administering a compound that inhibits EGFR activity. In another aspect, the instructions comprise the steps of (a) measuring in the mammal the level of at least one biomarker selected from the biomarkers of Table 1, (b) exposing the mammal to the compound, (c) following the exposing of step (b), measuring in the mammal the level of the at least one biomarker, wherein a difference in the level of the at least one biomarker measured in step (c) compared to the level of the at least one biomarker measured in step (a) indicates that the mammal will respond therapeutically to said method of treating cancer.

The invention also provides screening assays for determining if a patient will be susceptible or resistant to treatment with one or more EGFR modulators.

The invention also provides a method of monitoring the treatment of a patient having a disease, wherein said disease is treated by a method comprising administering one or more EGFR modulators.

The invention also provides individualized genetic profiles which are necessary to treat diseases and disorders based on patient response at a molecular level.

The invention also provides specialized microarrays, e.g., oligonucleotide microarrays or cDNA microarrays, comprising one or more biomarkers having expression profiles that correlate with either sensitivity or resistance to one or more EGFR modulators.

The invention also provides antibodies, including polyclonal or monoclonal, directed against one or more biomarkers of the invention.

The invention will be better understood upon a reading of the detailed description of the invention when considered in connection with the accompanying figures.

BRIEF DESCRIPTION OF THE FIGURES

FIG. 6 illustrates the filtering of candidate markers for cetuximab response. Expression data on 640 probe sets from 164 primary colorectal tumors was subjected to an unsupervised hierarchical clustering. The 164 tumors were divided into 3 major classes (Class 1, 2 and 3). The 640 probe sets were divided into 5 clusters (labeled A through E). Cluster A, which contains cancer antigens such as CEACAM 6 and CD24, also contains EREG and AREG. Cluster A is most highly expressed in Class 1a, which represents approximately 25% of the 164 colorectal tumor specimens.

FIG. 8 (FIGS. 8A and 8B) illustrates receiver operating characteristic (ROC) curves for prediction of patient response.

DETAILED DESCRIPTION OF THE INVENTION

Figure 1:
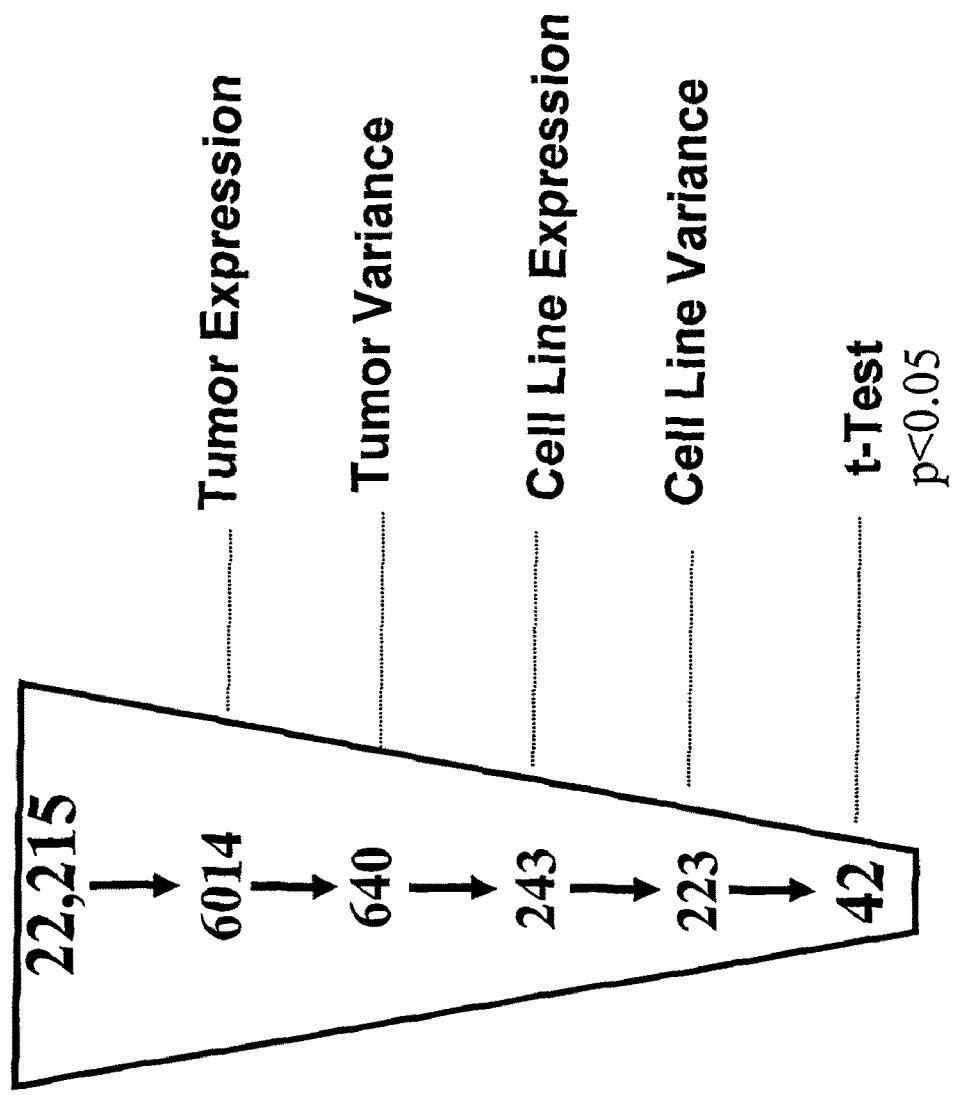
FIG. 1 illustrates a scheme used for identifying the biomarkers described herein.

Identification of biomarkers that provide rapid and accessible readouts of efficacy, drug exposure, or clinical response is increasingly important in the clinical development of drug candidates. Embodiments of the invention include measuring changes in the levels of secreted proteins, or plasma biomarkers, which represent one category of biomarker. In one aspect, plasma samples, which represent a readily accessible source of material, serve as surrogate tissue for biomarker analysis.

The invention provides biomarkers that respond to the modulation of a specific signal transduction pathway and also correlate with EGFR modulator sensitivity or resistance. These biomarkers can be employed for predicting response to one or more EGFR modulators. In one aspect, the biomarkers of the invention are those provided in Table 1 and the Sequence Listing, including both polynucleotide and polypeptide sequences. The invention also includes nucleotide sequences that hybridize to the polynucleotides provided in Table 1.

TABLE 1

| Biomarkers | | |
|---|---|---|
| Unigene title and SEQ ID NO: | Affymetrix Description | Affymetrix Probe Set |
| NT5E: 5'-nucleotidase, ecto (CD73) (LOC4907) SEQ ID NOS: 1 (DNA) and 129 (amino acid) | gb: NM_002526.1 /DEF = *Homo sapiens* 5 nucleotidase (CD73) (NT5), mRNA. /FEA = mRNA /GEN = NT5 /PROD = 5 nucleotidase /DB_XREF = gi: 4505466 /UG = Hs.153952 5 nucleotidase (CD73) /FL = gb: NM_002526.1 | 203939_at |
| EREG: epiregulin (LOC2069) SEQ ID NOS: 2 (DNA) and 130 (amino acid) | gb: NM_001432.1 /DEF = *Homo sapiens*. epiregulin (EREG), mRNA. /FEA = mRNA /GEN = EREG /PROD = epiregulin precursor /DB_XREF = gi: 4557566 /UG = Hs.115263 epiregulin /FL = gb: D30783.1 gb: NM_001432.1 | 205767_at |

TABLE 1-continued

Biomarkers

| Unigene title and SEQ ID NO: | Affymetrix Description | Affymetrix Probe Set |
| --- | --- | --- |
| AREG: amphiregulin (schwannoma-derived growth factor) (LOC374) SEQ ID NOS: 3 (DNA) and 131 (amino acid) | gb: NM_001657.1 /DEF = *Homo sapiens* amphiregulin (schwannoma-derived growth factor) (AREG), mRNA. /FEA = mRNA /GEN = AREG /PROD = amphiregulin (schwannoma-derived growth factor) /DB_XREF = gi: 4502198 /UG = Hs.270833 amphiregulin (schwannoma-derived growth factor) /FL = gb: M30704.1 gb: NM_001657.1 | 205239_at |
| LYZ: lysozyme (renal amyloidosis) (LOC4069) SEQ ID NOS: 4 (DNA) and 132 (amino acid) | Consensus includes gb: AV711904 /FEA = EST /DB_XREF = gi: 10731210 /DB_XREF = est: AV711904 /CLONE = DCAAIE08 /UG = Hs.277431 *Homo sapiens* cDNA: FLJ23356 fis, clone HEP14919 | 213975_s_at |
| BST2: bone marrow stromal cell antigen 2 (LOC684) SEQ ID NOS: 5 (DNA) and 133 (amino acid) | gb: NM_004335.2 /DEF = *Homo sapiens* bone marrow stromal cell antigen 2 (BST2), mRNA. /FEA = mRNA /GEN = BST2 /PROD = bone marrow stromal cell antigen 2 /DB_XREF = gi: 7262372 /UG = Hs.118110 bone marrow stromal cell antigen 2 /FL = gb: D28137.1 gb: NM_004335.2 | 201641_at |
| DUSP6: dual specificity phosphatase 6 (LOC1848) SEQ ID NOS: 6 (DNA) and 134 (amino acid) | gb: BC005047.1 /DEF = *Homo sapiens*, clone MGC: 12852, mRNA, complete cds. /FEA = mRNA /PROD = Unknown (protein for MGC: 12852) /DB_XREF = gi: 13477170 /UG = Hs.180383 dual specificity phosphatase 6 /FL = gb: BC003562.1 gb: BC003143.1 gb: BC005047.1 gb: AB013382.1 gb: NM_001946.1 | 208893_s_at |
| VAV3: vav 3 oncogene (LOC10451) SEQ ID NOS: 7 (DNA) and 135 (amino acid) | gb: NM_006113.2 /DEF = *Homo sapiens* vav 3 oncogene (VAV3), mRNA. /FEA = mRNA /GEN = VAV3 /PROD = vav 3 oncogene /DB_XREF = gi: 7262390 /UG = Hs.267659 vav 3 oncogene /FL = gb: AF067817.1 gb: AF118887.1 gb: NM_006113.2 | 218807_at |
| VAV3: vav 3 oncogene (LOC10451) SEQ ID NOS: 8 (DNA) and 136 (amino acid) | gb: AF118887.1 /DEF = *Homo sapiens* VAV-3 protein (VAV-3) mRNA, alternatively spliced, complete cds. /FEA = mRNA /GEN = VAV-3 /PROD = VAV-3 protein /DB_XREF = gi: 4416407 /UG = Hs.267659 vav 3 oncogene /FL = gb: AF067817.1 gb: AF118887.1 gb: NM_006113.2 | 218806_s_at |
| CCL2: chemokine (C-C motif) ligand 2 (LOC6347) SEQ ID NOS: 9 (DNA) and 137 (amino acid) | Consensus includes gb: S69738.1 /DEF = MCP-1 = monocyte chemotactic protein human, aortic endothelial cells, mRNA, 661 nt. /FEA = mRNA /GEN = MCP-1 /PROD = MCP-1 /DB_XREF = gi: 545464 /UG = Hs.303649 small inducible cytokine A2 (monocyte chemotactic protein 1, homologous to mouse Sig-je) | 216598_s_at |
| SATB2: SATB family member 2 (LOC23314) SEQ ID NOS: 10 (DNA) and 138 (amino acid) | Consensus includes gb: AB028957.1 /DEF = *Homo sapiens* mRNA for KIAA1034 protein, partial cds. /FEA = mRNA /GEN = KIAA1034 /PROD = KIAA1034 protein /DB_XREF = gi: 5689404 /UG = Hs.12896 KIAA1034 protein | 213435_at |
| AKAP12: A kinase (PRKA) anchor protein (gravin) 12 (LOC9590) SEQ ID NOS: 11 (DNA) and 139 (amino acid) | gb: AB003476.1 /DEF = *Homo sapiens* mRNA for gravin, complete cds. /FEA = mRNA /PROD = gravin /DB_XREF = gi: 2081606 /UG = Hs.788 A kinase (PRKA) anchor protein (gravin) 12 /FL = gb: AB003476.1 | 210517_s_at |
| GCNT3: glucosaminyl (N-acetyl) transferase 3, mucin type (LOC9245) | gb: NM_004751.1 /DEF = *Homo sapiens* glucosaminyl (N-acetyl) transferase 3, mucin type (GCNT3), mRNA. | 219508_at |

TABLE 1-continued

Biomarkers

| Unigene title and SEQ ID NO: | Affymetrix Description | Affymetrix Probe Set |
|---|---|---|
| SEQ ID NOS: 12 (DNA) and 140 (amino acid) | /FEA = mRNA /GEN = GCNT3 /PROD = glucosaminyl (N-acetyl) transferase 3, mucintype /DB_XREF = gi: 4758421 /UG = Hs.194710 glucosaminyl (N-acetyl) transferase 3, mucin type /FL = gb: AF102542.1 gb: AF038650.1 gb: NM_004751.1 | |
| SCRN1: secernin 1 (LOC9805) SEQ ID NOS: 13 (DNA) and 141 (amino acid) | gb: NM_014766.1 /DEF = *Homo sapiens* KIAA0193 gene product (KIAA0193), mRNA. /FEA = mRNA /GEN = KIAA0193 /PROD = KIAA0193 gene product /DB_XREF = gi: 7661983 /UG = Hs.75137 KIAA0193 gene product /FL = gb: D83777.1 gb: NM_014766.1 | 201462_at |
| FGFR3: fibroblast growth factor receptor 3 (achondroplasia, thanatophoric dwarfism) (LOC2261) SEQ ID NOS: 14 (DNA) and 142 (amino acid) | gb: NM_000142.2 /DEF = *Homo sapiens* fibroblast growth factor receptor 3 (achondroplasia, thanatophoric dwarfism) (FGFR3), transcript variant 1, mRNA. /FEA = mRNA /GEN = FGFR3 /PROD = Fibroblast growth factor receptor 3, isoform 1 precursor /DB_XREF = gi: 13112046 /UG = Hs.1420 fibroblast growth factor receptor 3 (achondroplasia, thanatophoric dwarfism) /FL = gb: NM_000142.2 gb: M58051.1 | 204379_s_at |
| LY96: lymphocyte antigen 96 (LOC23643) SEQ ID NOS: 15 (DNA) and 143 (amino acid) | gb: NM_015364.1 /DEF = *Homo sapiens* MD-2 protein (MD-2), mRNA. /FEA = mRNA /GEN = MD-2 /PROD = MD-2 protein /DB_XREF = gi: 7662503 /UG = Hs.69328 MD-2 protein /FL = gb: AB018549.1 gb: NM_015364.1 gb: AF168121.1 | 206584_at |
| CKB: creatine kinase, brain (LOC1152) SEQ ID NOS: 16 (DNA) and 144 (amino acid) | gb: NM_001823.1 /DEF = *Homo sapiens* creatine kinase, brain (CKB), mRNA. /FEA = mRNA /GEN = CKB /PROD = creatine kinase, brain /DB_XREF = gi: 4502850 /UG = Hs.173724 creatine kinase, brain /FL = gb: L47647.1 gb: BC001190.1 gb: BC004914.1 gb: M16364.1 gb: M16451.1 gb: NM_001823.1 | 200884_at |
| IFI16: interferon, gamma-inducible protein 16 (LOC3428) SEQ ID NOS: 17 (DNA) and 145 (amino acid) | gb: NM_005531.1 /DEF = *Homo sapiens* interferon, gamma-inducible protein 16 (IFI16), mRNA. /FEA = mRNA /GEN = IFI16 /PROD = interferon, gamma-inducible protein 16 /DB_XREF = gi: 5031778 /UG = Hs.155530 interferon, gamma-inducible protein 16 /FL = gb: M63838.1 gb: NM_005531.1 | 206332_s_at |
| PRSS8: protease, serine, 8 (prostasin) (LOC5652) SEQ ID NOS: 18 (DNA) and 146 (amino acid) | gb: NM_002773.1 /DEF = *Homo sapiens* protease, serine, 8 (prostasin) (PRSS8), mRNA. /FEA = mRNA /GEN = PRSS8 /PROD = protease, serine, 8 (prostasin) /DB_XREF = gi: 4506152 /UG = Hs.75799 protease, serine, 8 (prostasin) /FL = gb: BC001462.1 gb: NM_002773.1 gb: L41351.1 | 202525_at |
| IL1R2: interleukin 1 receptor, type II (LOC7850) SEQ ID NOS: 19 (DNA) and 147 (amino acid) | gb: NM_004633.1 /DEF = *Homo sapiens* interleukin 1 receptor, type II (IL1R2), mRNA. /FEA = mRNA /GEN = IL1R2 /PROD = interleukin 1 receptor, type II /DB_XREF = gi: 4758597 /UG = Hs.25333 interleukin 1 receptor, type II /FL = gb: U74649.1 gb: NM_004633.1 | 205403_at |
| BHLHB3: basic helix-loop-helix domain containing, class B, 3 (LOC79365) | Consensus includes gb: BE857425 /FEA = EST /DB_XREF = gi: 10371439 /DB_XREF = est: 7f97a11.x1 | 221530_s_at |

TABLE 1-continued

Biomarkers

| Unigene title and SEQ ID NO: | Affymetrix Description | Affymetrix Probe Set |
|---|---|---|
| SEQ ID NOS: 20 (DNA) and 148 (amino acid) | /CLONE = IMAGE: 3304892 /UG = Hs.33829 bHLH protein DEC2 /FL = gb: AB044088.1 | |
| HLA-DRB4: major histocompatibility complex, class II, DR beta 4 (LOC3126) SEQ ID NOS: 21 (DNA) and 149 (amino acid) | gb: BC005312.1 /DEF = *Homo sapiens*, clone MGC: 12387, mRNA, complete cds. /FEA = mRNA /PROD = Unknown (protein for MGC: 12387) /DB_XREF = gi: 13529055 /UG = Hs.318720 *Homo sapiens*, clone MGC: 12387, mRNA, complete cds /FL = gb: BC005312.1 gb: M16942.1 | 209728_at |
| CD163: CD163 antigen (LOC9332) SEQ ID NOS: 22 (DNA) and 150 (amino acid) | Consensus includes gb: Z22969.1 /DEF = *H. sapiens* mRNA for M130 antigen cytoplasmic variant 1. /FEA = mRNA /PROD = M130 antigen cytoplasmic variant 1 /DB_XREF = gi: 312143 /UG = Hs.74076 CD163 antigen | 215049_x_at |
| CD163: CD163 antigen (LOC9332) SEQ ID NOS: 23 (DNA) and 151 (amino acid) | gb: NM_004244.1 /DEF = *Homo sapiens* CD163 antigen (CD163), mRNA. /FEA: = mRNA /GEN = CD163 /PROD = CD163 antigen /DB_XREF = gi: 4758721 /UG = Hs.74076 CD163 antigen /FL = gb: NM_004244.1 | 203645_s_at |
| C13orf18: chromosome 13 open reading frame 18 (LOC80183) SEQ ID NOS: 24 (DNA) and 152 (amino acid) | gb: NM_025113.1 /DEF = *Homo sapiens* hypothetical protein FLJ21562 (FLJ21562), mRNA. /FEA = mRNA /GEN = FLJ21562 /PROD = hypothetical protein FLJ21562 /DB_XREF = gi: 13376686 /UG = Hs.288708 hypothetical protein FLJ21562 /FL = gb: NM_025113.1 | 219471_at |
| CCL11: chemokine (C-C motif) ligand 11 (LOC6356) SEQ ID NOS: 25 (DNA) and 153 (amino acid) | gb: D49372.1 /DEF = Human mRNA for eotaxin, complete cds. /FEA = mRNA /PROD = eotaxin /DB_XREF = gi: 1552240 /UG = Hs.54460 small inducible cytokine subfamily A (Cys-Cys), member 11 (eotaxin) /FL = gb: U46573.1 gb: D49372.1 gb: NM_002986.1 | 210133_at |
| SLC26A2: solute carrier family 26 (sulfate transporter), member 2 (LOC1836) SEQ ID NOS: 26 (DNA) and 154 (amino acid) | Consensus includes gb: AI025519 /FEA = EST /DB_XREF = gi: 3241132 /DB_XREF = est: ov75c04.x1 /CLONE = IMAGE: 1643142 /UG = Hs.29981 solute carrier family 26 (sulfate transporter), member 2 /FL = gb: NM_000112.1 gb: U14528.1 | 205097_at |
| HLA-DQB1: major histocompatibility complex, class II, DQ beta 1 (LOC3119) SEQ ID NOS: 27 (DNA) and 155 (amino acid) | gb: M32577.1 /DEF = Human MHC HLA-DQ beta mRNA, complete cds. /FEA = mRNA /GEN = HLA-DQB1 /DB_XREF = gi: 188194 /FL = gb: M32577.1 | 211656_x_at |
| ENPP2: ectonucleotide pyrophosphatase/phosphodiesterase 2 (autotaxin) (LOC5168) SEQ ID NOS: 28 (DNA) and 156 (amino acid) | gb: L35594.1 /DEF = Human autotaxin mRNA, complete cds. /FEA = mRNA /PROD = autotaxin /DB_XREF = gi: 537905 /UG = Hs.174185 ectonucleotide pyrophosphatasephosphodiesterase 2 (autotaxin) /FL = gb: L35594.1 | 209392_at |
| PRSS3: protease, serine, 3 (mesotrypsin) (LOC5646) SEQ ID NOS: 29 (DNA) and 157 (amino acid) | gb: NM_002770.1 /DEF = *Homo sapiens* protease, serine, 2 (trypsin 2) (PRSS2), mRNA. /FEA = mRNA /GEN = PRSS2 /PROD = protease, serine, 2 (trypsin 2) /DB_XREF = gi: 4506146 /UG = Hs.241561 protease, serine, 2 (trypsin 2) /FL = gb: NM_002770.1 gb: M27602.1 | 205402_x_at |
| CXCR4: chemokine (C—X—C motif) receptor 4 (LOC7852) SEQ ID NOS: 30 (DNA) and 158 (amino acid) | Consensus includes gb: AJ224869 /DEF = *Homo sapiens* CXCR4 gene encoding receptor CXCR4 /FEA = mRNA /DB_XREF = gi: 3059119 /UG = Hs.89414 chemokine (C—X—C motif), receptor 4 (fusin) | 217028_at |

TABLE 1-continued

Biomarkers

| Unigene title and SEQ ID NO: | Affymetrix Description | Affymetrix Probe Set |
|---|---|---|
| SERPINB5: serine (or cysteine) proteinase inhibitor, clade B (ovalbumin), member 5 (LOC5268) SEQ ID NOS: 31 (DNA) and 159 (amino acid) | gb: NM_002639.1 /DEF = *Homo sapiens* serine (or cysteine) proteinase inhibitor, clade B (ovalbumin), member 5 (SERPINB5), mRNA. /FEA = mRNA /GEN = SERPINB5 /PROD = serine (or cysteine) proteinase inhibitor, cladeB (ovalbumin), member 5 /DB_XREF = gi: 4505788 /UG = Hs.55279 serine (or cysteine) proteinase inhibitor, clade B (ovalbumin), member 5 /FL = gb: NM_002639.1 gb: U04313.1 | 204855_at |
| HLA-DPB1: major histocompatibility complex, class II, DP beta 1 (LOC3115) SEQ ID NOS: 32 (DNA) and 160 (amino acid) | gb: NM_002121.1 /DEF = *Homo sapiens* major histocompatibility complex, class II, DP beta 1 (HLA-DPB1), mRNA. /FEA = mRNA /GEN = HLA-DPB1 /PROD = major histocompatibility complex, class II, DPbeta 1 /DB_XREF = gi: 4504404 /UG = Hs.814 major histocompatibility complex, class II, DP beta 1 /FL = gb: J03041.1 gb: M57466.1 gb: M83664.1 gb: NM_002121.1 gb: M28200.1 gb: M28202.1 | 201137_s_at |
| AIF1: allograft inflammatory factor 1 (LOC199) SEQ ID NOS: 33 (DNA) and 161 (amino acid) | Consensus includes gb: BF213829 /FEA = EST /DB_XREF = gi: 11107415 /DB_XREF = est: 601848003F1 /CLONE = IMAGE: 4078849 /UG = Hs.76364 allograft inflammatory factor 1 | 215051_x_at |
| IL8: interleukin 8 (LOC3576) SEQ ID NOS: 34 (DNA) and 162 (amino acid) | gb: NM_000584.1 /DEF = *Homo sapiens* interleukin 8 (IL8), mRNA. /FEA = mRNA /GEN = IL8 /PROD = interleukin 8 /DB_XREF = gi: 10834977 /UG = Hs.624 interleukin 8 /FL = gb: NM_000584.1 gb: M17017.1 gb: M26383.1 | 202859_x_at |
| IL8: interleukin 8 (LOC3576) SEQ ID NOS: 35 (DNA) and 163 (amino acid) | gb: AF043337.1 /DEF = *Homo sapiens* interleukin 8 C-terminal variant (IL8) mRNA, complete cds. /FEA = mRNA /GEN = IL8 /PROD = interleukin 8 C-terminal variant /DB_XREF = gi: 12641914 /UG = Hs.624 interleukin 8 /FL = gb: AF043337.1 | 211506_s_at |
| LY6G6D: lymphocyte antigen 6 complex, locus G6D (LOC58530) SEQ ID NOS: 36 (DNA) and 164 (amino acid) | gb: NM_021246.1 /DEF = *Homo sapiens* megakaryocyte-enhanced gene transcript 1 protein (MEGT1), mRNA. /FEA = mRNA /GEN = MEGT1 /PROD = megakaryocyte-enhanced gene transcript 1protein /DB_XREF = gi: 10864054 /UG = Hs.241587 megakaryocyte-enhanced gene transcript 1 protein /FL = gb: NM_021246.1 gb: AF195764.1 | 207457_s_at |
| CYP3A5: cytochrome P450, family 3, subfamily A, polypeptide 5 (LOC1577) SEQ ID NOS: 37 (DNA) and 165 (amino acid) | gb: NM_000777.1 /DEF = *Homo sapiens* cytochrome P450, subfamily IIIA (niphedipine oxidase), polypeptide 5 (CYP3A5), mRNA. /FEA = mRNA /GEN = CYP3A5 /PROD = cytochrome P450, subfamily IIIA, polypeptide 5 /DB_XREF = gi: 4503230 /UG = Hs.104117 cytochrome P450, subfamily IIIA (niphedipine oxidase), polypeptide 5 /FL gb: J04813.1 gb: NM_000777.1 | 205765_at |
| CSPG2: chondroitin sulfate proteoglycan 2 (versican) (LOC1462) SEQ ID NOS: 38 (DNA) and 166 (amino acid) | Consensus includes gb: BF590263 /FEA = EST /DB_XREF = gi: 11682587 /DB_XREF = est: nab22b12.x1 /CLONE = IMAGE: 3266638 /UG = Hs.81800 chondroitin sulfate proteoglycan 2 (versican) /FL = gb: NM_004385.1 | 204619_s_at |
| CA9: carbonic anhydrase IX (LOC768) | gb: NM_001216.1 /DEF = *Homo sapiens* carbonic anhydrase IX (CA9), mRNA. | 205199_at |

TABLE 1-continued

Biomarkers

| Unigene title and SEQ ID NO: | Affymetrix Description | Affymetrix Probe Set |
|---|---|---|
| SEQ ID NOS: 39 (DNA) and 167 (amino acid) | /FEA = mRNA /GEN = CA9 /PROD = carbonic anhydrase IX precursor /DB_XREF = gi: 9955947 /UG = Hs.63287 carbonic anhydrase IX /FL = gb: NM_001216.1 | |
| ACE2: angiotensin I converting enzyme (peptidyl-dipeptidase A) 2 (LOC59272) SEQ ID NOS: 40 (DNA) and 168 (amino acid) | gb: NM_021804.1 /DEF = Homo sapiens angiotensin I converting enzyme (peptidyl-dipeptidase A) 2 (ACE2), mRNA. /FEA = mRNA /GEN = ACE2 /PROD = angiotensin I converting enzyme(peptidyl-dipeptidase A) 2 /DB_XREF = gi: 11225608 /UG = Hs.178098 angiotensin I converting enzyme (peptidyl-dipeptidase A) 2 /FL = gb: NM_021804.1 gb: AB046569.1 gb: AF241254.1 gb: AF291820.1 | 219962_at |
| CXCL13: chemokine (C—X—C motif) ligand 13 (B-cell chemoattractant) (LOC10563) SEQ ID NOS: 41 (DNA) and 169 (amino acid) | gb: NM_006419.1 /DEF = Homo sapiens small inducible cytokine B subfamily (Cys-X-Cys motif), member 13 (B-cell chemoattractant) (SCYB13), mRNA. /FEA = mRNA /GEN = SCYB13 /PROD = small inducible cytokine B subfamily (Cys-X-Cysmotif), member 13 (B-cell chemoattractant) /DB_XREF = gi: 5453576 /UG = Hs.100431 small inducible cytokine B subfamily (Cys-X-Cys motif), member 13 (B-cell chemoattractant) /FL = gb: AF044197.1 gb: AF029894.1 gb: NM_006419.1 | 205242_at |
| COL10A1: collagen, type X, alpha 1(Schmid metaphyseal chondrodysplasia) (LOC1300) SEQ ID NOS: 42 (DNA) and 170 (amino acid) | Consensus includes gb: X98568 /DEF = H. sapiens type X collagen gene /FEA = mRNA /DB_XREF = gi: 1405722 /UG = Hs.179729 collagen, type X, alpha 1 (Schmid metaphyseal chondrodysplasia) | 217428_s_at |
| CPNE1: copine I (LOC8904) SEQ ID NOS: 43 (DNA) and 171 (amino acid) | gb: NM_003915.1 /DEF = Homo sapiens copine I (CPNE1), mRNA. /FEA = mRNA /GEN = CPNE1 /PROD = copine I /DB_XREF = gi: 4503012 /UG = Hs.166887 copine I /FL = gb: U83246.1 gb: NM_003915.1 | 206918_s_at |
| C13orf18: chromosome 13 open reading frame 18 (LOC80183) SEQ ID NOS: 44 (DNA) and 172 (amino acid) | Cluster Incl. AI129310: qc48a05.x1 Homo sapiens cDNA, 3 end /clone = IMAGE-1712816 /clone_end = 3' /gb = AI129310 /gi = 3597824 /ug = Hs.234923 /len = 811 | 44790_s_at |
| GREM1: gremlin 1 homolog, cysteine knot superfamily (Xenopus laevis) (LOC26585) SEQ ID NOS: 45 (DNA) and 173 (amino acid) | gb: NM_013372.1 /DEF = Homo sapiens cysteine knot superfamily 1, BMP antagonist 1 (CKTSF1B1), mRNA. /FEA = mRNA /GEN = CKTSF1B1 /PROD = cysteine knot superfamily 1, BMP antagonist 1 /DB_XREF = gi: 7019348 /UG = Hs.40098 cysteine knot superfamily 1, BMP antagonist 1 /FL = gb: AF154054.1 gb: AF045800.1 gb: AF110137.2 gb: NM_013372.1 | 218469_at |
| HLA-DQB1: major histocompatibility complex, class II, DQ beta 1 (LOC3119) SEQ ID NOS: 46 (DNA) and 174 (amino acid) | gb: M17955.1 /DEF = Human MHC class II HLA-DQ-beta mRNA, complete cds. /FEA = mRNA /DB_XREF = gi: 188178 /UG = Hs.73931 major histocompatibility complex, class II, DQ beta 1 /FL = gb: M33907.1 gb: M17955.1 gb: M17563.1 gb: M26042.1 gb: M20432.1 gb: M16996.1 | 209823_x_at |
| TCN1: transcobalamin I (vitamin B12 binding protein, R binder family) (LOC6947) SEQ ID NOS: 47 (DNA) and 175 (amino acid) | gb: NM_001062.1 /DEF = Homo sapiens transcobalamin I (vitamin B12 binding protein, R binder family) (TCN1), mRNA. /FEA = mRNA /GEN = TCN1 /PROD = transcobalamin I (vitamin B12 binding protein, Rbinder family) | 205513_at |

TABLE 1-continued

Biomarkers

| Unigene title and SEQ ID NO: | Affymetrix Description | Affymetrix Probe Set |
|---|---|---|
| PIGR: polymeric immunoglobulin receptor (LOC5284)<br>SEQ ID NOS: 48 (DNA) and 176 (amino acid) | /DB_XREF = gi: 4507406 /UG = Hs.2012 transcobalamin I (vitamin B12 binding protein, R binder family)<br>/FL = gb: J05068.1 gb: NM_001062.1 gb: NM_002644.1 /DEF = *Homo sapiens* polymeric immunoglobulin receptor (PIGR), mRNA. /FEA = mRNA /GEN = PIGR /PROD = polymeric immunoglobulin receptor /DB_XREF = gi: 11342673 /UG = Hs.288579 polymeric immunoglobulin receptor /FL = gb: NM_002644.1 | 204213_at |
| COL10A1: collagen, type X, alpha 1(Schmid metaphyseal chondrodysplasia) (LOC1300)<br>SEQ ID NOS: 49 (DNA) and 177 (amino acid) | Consensus includes gb: AI376003 /FEA = EST /DB_XREF = gi: 4175993 /DB_XREF = est: tc30d11.x1 /CLONE = IMAGE: 2066133 /UG = Hs.179729 collagen, type X, alpha 1 (Schmid metaphyseal chondrodysplasia) /FL: = gb: NM_000493.1 | 205941_s_at |
| KCTD12: potassium channel tetramerisation domain containing 12 (LOC115207)<br>SEQ ID NOS: 50 (DNA) and 178 (amino acid) | Consensus includes gb: AI718937 /FEA = EST /DB_XREF = gi: 5036193 /DB_XREF = est: as50b04.x1 /CLONE = IMAGE: 2320591 /UG = Hs.109438 *Homo sapiens* clone 24775 mRNA sequence | 212192_at |
| LCK: lymphocyte-specific protein tyrosine kinase (LOC3932)<br>SEQ ID NOS: 51 (DNA) and 179 (amino acid) | gb: NM_005356.1 /DEF = *Homo sapiens* lymphocyte-specific protein tyrosine kinase (LCK), mRNA. /FEA = mRNA /GEN = LCK /PROD = lymphocyte-specific protein tyrosine kinase /DB_XREF = gi: 4885448 /UG = Hs.1765 lymphocyte-specific protein tyrosine kinase /FL = gb: M36881.1 gb: U07236.1 gb: NM_005356.1 | 204891_s_at |
| LAPTM4B: lysosomal associated protein transmembrane 4 beta (LOC55353)<br>SEQ ID NOS: 52 (DNA) and 180 (amino acid) | gb: NM_018407.1 /DEF = *Homo sapiens* putative integral membrane transporter (LC27), mRNA. /FEA = mRNA /GEN = LC27 /PROD = putative integral membrane transporter /DB_XREF = gi: 8923827 /FL = gb: NM_018407.1 | 208029_s_at |
| CEACAM5: carcinoembryonic antigen-related cell adhesion molecule 5 (LOC1048)<br>SEQ ID NOS: 53 (DNA) and 181 (amino acid) | gb: NM_004363.1 /DEF = *Homo sapiens* carcinoembryonic antigen-related cell adhesion molecule 5 (CEACAM5), mRNA. /FEA = mRNA /GEN = CEACAM5 /PROD = carcinoembryonic antigen-related cell adhesionmolecule 5 /DB_XREF = gi: 11386170 /UG = Hs.220529 carcinoembryonic antigen-related cell adhesion molecule 5 /FL = gb: NM_004363.1 gb: M29540.1 | 201884_at |
| LDHB: lactate dehydrogenase B (LOC3945)<br>SEQ ID NOS: 54 (DNA) and 182 (amino acid) | gb: NM_002300.1 /DEF = *Homo sapiens* lactate dehydrogenase B (LDHB), mRNA. /FEA = mRNA /GEN = LDHB /PROD = lactate dehydrogenase B /DB_XREF = gi: 4557031 /UG = Hs.234489 lactate dehydrogenase B /FL = gb: BC002362.1 gb: NM_002300.1 | 201030_x_at |
| IFI27: interferon, alpha-inducible protein 27 (LOC3429)<br>SEQ ID NOS: 55 (DNA) and 183 (amino acid) | gb: NM_005532.1 /DEF = *Homo sapiens* interferon, alpha-inducible protein 27 (IFI27), mRNA. /FEA = mRNA /GEN = IFI27 /PROD = interferon, alpha-inducible protein 27 /DB_XREF = gi: 5031780 /UG = Hs.278613 interferon, alpha-inducible protein 27 /FL = gb: NM_005532.1 | 202411_at |
| EPHB2: EphB2 (LOC2048)<br>SEQ ID NOS: 56 (DNA) and 184 (amino acid) | gb: D31661.1 /DEF = Human mRNA for tyrosine kinase, complete cds. /FEA = mRNA /GEN = ERK /PROD = tyrosine kinase precursor | 211165_x_at |

TABLE 1-continued

Biomarkers

| Unigene title and SEQ ID NO: | Affymetrix Description | Affymetrix Probe Set |
|---|---|---|
| | /DB_XREF = gi: 495677 /UG = Hs.125124 EphB2 /FL = gb: D31661.1 | |
| ACACA: acetyl-Coenzyme A carboxylase alpha (LOC31) SEQ ID NOS: 57 (DNA) and 185 (amino acid) | Consensus includes gb: BE855983 /FEA = EST /DB_XREF = gi: 10368561 /DB_XREF = est: 7f85g11.x1 /CLONE = IMAGE: 3303812 /UG = Hs.7232 acetyl-Coenzyme A carboxylase alpha /FL = gb: NM_000664.1 gb: U19822.1 | 212186_at |
| CD14: CD14 antigen (LOC929) SEQ ID NOS: 58 (DNA) and 186 (amino acid) | gb: NM_000591.1 /DEF = *Homo sapiens* CD14 antigen (CD14), mRNA. /FEA = mRNA /GEN = CD14 /PROD = CD14 antigen precursor /DB_XREF = gi: 4557416 /UG = Hs.75627 CD14 antigen /FL = gb: M86511.1 gb: AF097942.1 gb: NM_000591.1 | 201743_at |
| ABHD2: abhydrolase domain containing 2 (LOC11057) SEQ ID NOS: 59 (DNA) and 187 (amino acid) | Cluster Incl. AI832249: td14g10.x1 *Homo sapiens* cDNA, 3 end /clone = IMAGE-2075682 /clone_end = 3' /gb = AI832249 /gi = 5452920 /ug = Hs.211522 /len = 545 | 87100_at |
| TNFRSF6B: tumor necrosis factor receptor superfamily, member 6b, decoy (LOC8771) SEQ ID NOS: 60 (DNA) and 188 (amino acid) | gb: NM_003823.1 /DEF = *Homo sapiens* tumor necrosis factor receptor superfamily, member 6b, decoy (TNFRSF6B), mRNA. /FEA = mRNA /GEN = TNFRSF6B /PROD = decoy receptor 3 /DB_XREF = gi: 4507584 /UG = Hs.278556 tumor necrosis factor receptor superfamily, member 6b, decoy /FL = gb: AF104419.1 gb: NM_003823.1 gb: AF134240.1 gb: AF217794.1 | 206467_x_at |
| GREM1: gremlin 1 homolog, cysteine knot superfamily (*Xenopus laevis*) (LOC26585) SEQ ID NOS: 61 (DNA) and 189 (amino acid) | gb: AF154054.1 /DEF = *Homo sapiens* DRM (DRM) mRNA, complete cds. /FEA = mRNA /GEN = DRM /PROD = DRM /DB_XREF = gi: 10863087 /UG = Hs.40098 cysteine knot superfamily 1, BMP antagonist 1 /FL = gb: AF154054.1 gb: AF045800.1 gb: AF110137.2 gb: NM_013372.1 | 218468_s_at |
| ACE2: angiotensin I converting enzyme (peptidyl-dipeptidase A) 2 (LOC59272) SEQ ID NOS: 62 (DNA) and 190 (amino acid) | Consensus includes gb: AK026461.1 /DEF = *Homo sapiens* cDNA: FLJ22808 fis, clone KAIA2925. /FEA = mRNA /DB_XREF = gi: 10439331 /UG = Hs.178098 angiotensin I converting enzyme (peptidyl-dipeptidase A) 2 | 222257_s_at |
| COL5A2: collagen, type V, alpha 2 (LOC1290) SEQ ID NOS: 63 (DNA) and 191 (amino acid) | Consensus includes gb: NM_000393.1 /DEF = *Homo sapiens* collagen, type V, alpha 2 (COL5A2), mRNA. /FEA = CDS /GEN = COL5A2 /PROD = collagen, type V, alpha 2 /DB_XREF = gi: 4502958 /UG = Hs.82985 collagen, type V, alpha 2 /FL = gb: NM_000393.1 | 221730_at |
| CXCL9: chemokine (C—X—C motif) ligand 9 (LOC4283) SEQ ID NOS: 64 (DNA) and 192 (amino acid) | gb: NM_002416.1 /DEF = *Homo sapiens* monokine induced by gamma interferon (MIG), mRNA. /FEA = mRNA /GEN = MIG /PROD = monokine induced by gamma interferon /DB_XREF = gi: 4505186 /UG = Hs.77367 monokine induced by gamma interferon /FL = gb: NM_002416.1 | 203915_at |
| HOXC6: homeo box C6 (LOC3223) SEQ ID NOS: 65 (DNA) and 193 (amino acid) | gb: NM_004503.1 /DEF = *Homo sapiens* homeo box C6 (HOXC6), mRNA. /FEA = mRNA /GEN = HOXC6 /PROD = homeo box C6 /DB_XREF = gi: 4758553 /UG = Hs.820 homeo box C6 /FL = gb: NM_004503.1 | 206858_s_at |
| KCNMA1: potassium large conductance calcium-activated | gb: U11058.2 /DEF = *Homo sapiens* large conductance calcium- and | 221584_s_at |

TABLE 1-continued

Biomarkers

| Unigene title and SEQ ID NO: | Affymetrix Description | Affymetrix Probe Set |
|---|---|---|
| channel, subfamily M, alpha member 1 (LOC3778) SEQ ID NOS: 66 (DNA) and 194 (amino acid) | voltage-dependent potassium channel alpha subunit (MaxiK) mRNA, complete cds. /FEA = mRNA /GEN = MaxiK /PROD = large conductance calcium- and voltage-dependentpotassium channel alpha subunit /DB_XREF = gi: 7914977 /UG = Hs.89463 potassium large conductance calcium-activated channel, subfamily M, alpha member 1 /FL = gb: AF025999.1 gb: NM_002247.1 gb: AF118141.1 gb: U13913.1 gb: U11717.1 gb: U23767.1 gb: U11058.2 | |
| MMP1: matrix metalloproteinase 1 (interstitial collagenase) (LOC4312) SEQ ID NOS: 67 (DNA) and 195 (amino acid) | gb: NM_002421.2 /DEF = *Homo sapiens* matrix metalloproteinase 1 (interstitial collagenase) (MMP1), mRNA. /FEA = mRNA /GEN = MMP1 /PROD = matrix metalloproteinase 1 preproprotein /DB_XREF = gi: 13027798 /UG = Hs.83169 matrix metalloproteinase 1 (interstitial collagenase) /FL = gb: NM_002421.2 gb: M13509.1 | 204475_at |
| PLCB4: phospholipase C, beta 4 (LOC5332) SEQ ID NOS: 68 (DNA) and 196 (amino acid) | Consensus includes gb: AL535113 /FEA = EST /DB_XREF = gi: 12798606 /DB_XREF = est: AL535113 /CLONE = CS0DF008YC23 (3 prime) /UG = Hs.283006 phospholipase C, beta 4 /FL = gb: NM_000933.1 gb: L41349.1 | 203895_at |
| PTPRD: protein tyrosine phosphatase, receptor type, D (LOC5789) SEQ ID NOS: 69 (DNA) and 197 (amino acid) | Consensus includes gb: BF062299 /FEA = EST /DB_XREF = gi: 10821197 /DB_XREF = est: 7k76c03.x1 /CLONE = IMAGE: 3481325 /UG = Hs.323079 *Homo sapiens* mRNA; cDNA DKFZp564P116 (from clone DKFZp564P116) | 214043_at |
| KCNK1: potassium channel, subfamily K, member 1 (LOC3775) SEQ ID NOS: 70 (DNA) and 198 (amino acid) | gb: U90065.1 /DEF = Human potassium channel KCNO1 mRNA, complete cds. /FEA = mRNA /PROD = potassium channel KCNO1 /DB_XREF = gi: 1916294 /UG = Hs.79351 potassium channel, subfamily K, member 1 (TWIK-1) /FL = gb: U33632.1 gb: U90065.1 gb: U76996.1 gb: NM_002245.1 | 204678_s_at |
| ALOX5: arachidonate 5-lipoxygenase (LOC240) SEQ ID NOS: 71 (DNA) and 199 (amino acid) | gb: NM_000698.1 /DEF = *Homo sapiens* arachidonate 5-lipoxygenase (ALOX5), mRNA. /FEA = mRNA /GEN = ALOX5 /PROD = arachidonate 5-lipoxygenase /DB_XREF = gi: 4502056 /UG = Hs.89499 arachidonate 5-/ipoxygenase /FL = gb: J03600.1 gb: J03571.1 gb: NM_000698.1 | 204446_s_at |
| CXCL10: chemokine (C—X—C motif) ligand 10 (LOC3627) SEQ ID NOS: 72 (DNA) and 200 (amino acid) | gb: NM_001565.1 /DEF = *Homo sapiens* small inducible cytokine subfamily B (Cys-X-Cys), member 10 (SCYB10), mRNA. /FEA = mRNA /GEN = SCYB10 /PROD = interferon gamma-induced precursor /DB_XREF = gi: 4504700 /UG = Hs.2248 small inducible cytokine subfamily B (Cys-X-Cys), member 10 /FL = gb: NM_001565.1 | 204533_at |
| TMPRSS2: transmembrane protease, serine 2 (LOC7113) SEQ ID NOS: 73 (DNA) and 201 (amino acid) | gb: AF270487.1 /DEF = *Homo sapiens* androgen-regulated serine protease TMPRSS2 precursor (TMPRSS2) mRNA, complete cds. /FEA = mRNA /GEN = TMPRSS2 /PROD = androgen-regulated serine protease TMPRSS2precursor /DB_XREF = gi: 13540003 /FL = gb: AF270487.1 | 211689_s_at |

TABLE 1-continued

Biomarkers

| Unigene title and SEQ ID NO: | Affymetrix Description | Affymetrix Probe Set |
|---|---|---|
| PRG1: proteoglycan 1, secretory granule (LOC5552) SEQ ID NOS: 74 (DNA) and 202 (amino acid) | gb: J03223.1 /DEF = Human secretory granule proteoglycan peptide core mRNA, complete cds. /FEA = mRNA /GEN = PRG1 /DB_XREF = gi: 190419 /UG = Hs.1908 proteoglycan 1, secretory granule /FL = gb: J03223.1 gb: NM_002727.1 | 201858_s_at |
| HLA-DQA1: major histocompatibility complex, class II, DQ alpha 1 (LOC3117) SEQ ID NOS: 75 (DNA) and 203 (amino acid) | Consensus includes gb: BG397856 /FEA = EST /DB_XREF = gi: 13291304 /DB_XREF = est: 602438950F1 /CLONE = IMAGE: 4564956 /UG = Hs.198253 major histocompatibility complex, class II, DQ alpha 1 | 212671_s_at |
| NR4A2: nuclear receptor subfamily 4, group A, member 2 (LOC4929) SEQ ID NOS: 76 (DNA) and 204 (amino acid) | Consensus includes gb: S77154.1 /DEF = TINUR = NGFI-Bnur77 beta-type transcription factor homolog human, T lymphoid cell line, PEER, mRNA, 2469 nt. /FEA = mRNA /GEN = TINUR /DB_XREF = gi: 913966 /UG = Hs.82120 nuclear receptor subfamily 4, group A, member 2 | 216248_s_at |
| KCTD12: potassium channel tetramerisation domain containing 12 (LOC115207) SEQ ID NOS: 77 (DNA) and 205 (amino acid) | Consensus includes gb: AA551075 /FEA = EST /DB_XREF = gi: 2321327 /DB_XREF = est: nk74h06.s1 /CLONE = IMAGE: 1019291 /UG = Hs.109438 Homo sapiens clone 24775 mRNA sequence | 212188_at |
| RARRES3: retinoic acid receptor responder (tazarotene induced) 3 (LOC5920) SEQ ID NOS: 78 (DNA) and 206 (amino acid) | gb: NM_004585.2 /DEF = Homo sapiens retinoic acid receptor responder (tazarotene induced) 3 (RARRES3), mRNA. /FEA = mRNA /GEN = RARRES3 /PROD = retinoic acid receptor responder (tazaroteneinduced) 3 /DB_XREF = gi: 8051633 /UG = Hs.17466 retinoic acid receptor responder (tazarotene induced) 3 /FL = gb: AF060228.1 gb: AF092922.1 gb: NM_004585.2 gb: AB030815.1 | 204070_at |
| LDHB: lactate dehydrogenase B (LOC3945) SEQ ID NOS: 79 (DNA) and 207 (amino acid) | Consensus includes gb: BE042354 /FEA = EST /DB_XREF = gi: 8359407 /DB_XREF = est: ho19b09.x1 /CLONE = IMAGE: 3037817 /UG = Hs.234489 lactate dehydrogenase B | 213564_x_at |
| CLECSF2: C-type (calcium dependent, carbohydrate-recognition domain) lectin, superfamily member 2 (activation-induced) (LOC9976) SEQ ID NOS: 80 (DNA) and 208 (amino acid) | gb: BC005254.1 /DEF = Homo sapiens, Similar to C-type (calcium dependent, carbohydrate-recognition domain) lectin, superfamily member 2 (activation-induced), clone MGC: 12289, mRNA, complete cds. /FEA = mRNA /PROD = Siniilar to C-type (calcium dependent, carbohydrate-recognition domain) lectin, superfamilymember 2 (activation-induced) /DB_XREF = gi: 13528920 /UG = Hs.85201 C-type (calcium dependent, carbohydrate-recognition domain) lectin, superfamily member 2 (activation-induced) /FL = gb: BC005254.1 gb: AB015628.1 gb: NM_005127.1 | 209732_at |
| FLNA: filamin A, alpha (actin binding protein 280) (LOC2316) SEQ ID NOS: 81 (DNA) and 209 (amino acid) | Consensus includes gb: AW051856 /FEA = EST /DB_XREF = gi: 5914215 /DB_XREF = est: wz04a05.x1 /CLONE = IMAGE: 2557040 /UG = Hs.195464 filamin A, alpha (actin-binding protein-280) | 213746_s_at |
| CXCL5: chemokine (C—X—C motif) ligand 5 (LOC6374) SEQ ID NOS: 82 (DNA) and 210 (amino acid) | Consensus includes gb: AK026546.1 /DEF = Homo sapiens cDNA: FLJ22893 fis, clone KAT04792. /FEA = mRNA /DB_XREF = gi: 10439427 /UG = Hs.287716 Homo sapiens cDNA: FLJ22893 fis, clone KAT04792 | 214974_x_at |

TABLE 1-continued

Biomarkers

| Unigene title and SEQ ID NO: | Affymetrix Description | Affymetrix Probe Set |
|---|---|---|
| AEBP1: AE binding protein 1 (LOC165) SEQ ID NOS: 83 (DNA) and 211 (amino acid) | gb: NM_001129.2 /DEF = Homo sapiens AE-binding protein 1 (AEBP1), mRNA. /FEA = mRNA /GEN = AEBP1 /PROD = adipocyte enhancer binding protein 1 precursor /DB_XREF = gi: 4755145 /UG = Hs.118397 AE-binding protein 1 /FL = gb: D86479.1 gb: AF053944. 1 gb: NM_001129.2 | 201792_at |
| BGN: biglycan (LOC633) SEQ ID NOS: 84 (DNA) and 212 (amino acid) | Consensus includes gb: AA845258 /FEA = EST /DB_XREF = gi: 2931709 /DB_XREF = est: ak84a11.s1 /CLONE = IMAGE: 1414556 /UG = Hs.821 biglycan | 213905_x_at |
| SULF1: sulfatase 1 (LOC23213) SEQ ID NOS: 85 (DNA) and 213 (amino acid) | Consensus includes gb: AI479175 /FEA = EST /DB_XREF = gi: 4372343 /DB_XREF = est: tm55c05.x1 /CLONE = IMAGE: 2162024 /UG = Hs.70823 KIAA1077 protein | 212353_at |
| COL6A2: collagen, type VI, alpha 2 (LOC1292) SEQ ID NOS: 86 (DNA) and 214 (amino acid) | gb: AY029208.1 /DEF = Homo sapiens type VI collagen alpha 2 chain precursor (COL6A2) mRNA, complete cds, alternatively spliced. /FEA = mRNA /GEN = COL6A2 /PROD = type VI collagen alpha 2 chain precursor /DB_XREF = gi: 13603393 /UG = Hs.159263 collagen, type VI, alpha 2 /FL = gb: AY029208.1 | 209156_s_at |
| THBS2: thrombospondin 2 (LOC7058) SEQ ID NOS: 87 (DNA) and 215 (amino acid) | gb: NM_003247.1 /DEF = Homo sapiens thrombospondin 2 (THBS2), mRNA. /FEA = mRNA /GEN = THBS2 /PROD = thrombospondin 2 /DB_XREF = gi: 4507486 /UG = Hs.108623 thrombospondin 2 /FL = gb: L12350.1 gb: NM_003247.1 | 203083_at |
| PLCB4: phospholipase C, beta 4 (LOC5332) SEQ ID NOS: 88 (DNA) and 216 (amino acid) | gb: NM_000933.1 /DEF = Homo sapiens phospholipase C, beta 4 (PLCB4), mRNA. /FEA = mRNA /GEN = PLCB4 /PROD = phospholipase C, beta 4 /DB_XREF = gi: 4505866 /UG = Hs.283006 phospholipase C, beta 4 /FL = gb: NM_000933.1 gb: L41349.1 | 203896_s_at |
| CALD1: caldesmon 1 (LOC800) SEQ ID NOS: 89 (DNA) and 217 (amino acid) | gb: NM_004342.2 /DEF = Homo sapiens caldesmon 1 (CALD1), mRNA. /FEA = mRNA /GEN = CALD1 /PROD = caldesmon 1 /DB_XREF = gi: 11091984 /UG = Hs.325474 caldesmon 1 /FL = gb: NM_004342.2 gb: M64110.1 | 201617_x_at |
| NGFRAP1: nerve growth factor receptor (TNFRSF16) associated protein 1 (LOC27018) SEQ ID NOS: 90 (DNA) and 218 (amino acid) | gb: NM_014380.1 /DEF = Homo sapiens p75NTR-associated cell death executor; ovarian granulosa cell protein (13 kD) (DXS6984E), mRNA. /FEA = mRNA /GEN = DXS6984E /PROD = p75NTR-associated cell death executor; ovariangranulosa cell protein (13 kD) /DB_XREF = gi: 7657043 /UG = Hs.17775 p75NTR-associated cell death executor; ovarian granulosa cell protein (13 kD) /FL = gb: NM_014380.1 gb: AF187064.1 | 217963_s_at |
| IFI16: interferon, gamma-inducible protein 16 (LOC3428) SEQ ID NOS: 91 (DNA) and 219 (amino acid) | Consensus includes gb: BG256677 /FEA = EST /DB_XREF = gi: 12766493 /DB_XREF = est: 602370865F1 /CLONE = IMAGE: 4478872 /UG = Hs.155530 interferon, gamma-inducible protein 16 /FL = gb: AF208043.1 | 208965_s_at |
| RAB31: RAB31, member RAS oncogene family (LOC11031) SEQ ID NOS: 92 (DNA) and 220 (amino acid) | gb: NM_006868.1 /DEF = Homo sapiens RAB31, member RAS oncogene family (RAB31), mRNA. /FEA = mRNA /GEN = RAB31 /PROD = RAB31, member RAS oncogene family /DB_XREF = gi: 5803130 /UG = Hs.223025 RAB31, member RAS | 217763_s_at |

TABLE 1-continued

Biomarkers

| Unigene title and SEQ ID NO: | Affymetrix Description | Affymetrix Probe Set |
|---|---|---|
| | oncogene family /FL = gb: AF234995.1 gb: BC001148.1 gb: U59877.1 gb: U57091.1 gb: NM_006868.1 gb: AF183421.1 | |
| COL5A1: collagen, type V, alpha 1 (LOC1289) SEQ ID NOS: 93 (DNA) and 221 (amino acid) | Consensus includes gb: AI130969 /FEA = EST /DB_XREF = gi: 3600985 /DB_XREF = est: qc15e01.x1 /CLONE = IMAGE: 1709688 /UG = Hs.146428 collagen, type V, alpha 1 /FL = gb: M76729.1 gb: D90279.1 gb: NM_000093.1 | 203325_s_at |
| KLK10: kallikrein 10 (LOC5655) SEQ ID NOS: 94 (DNA) and 222 (amino acid) | gb: BC002710.1 /DEF = *Homo sapiens*, kallikrein 10, clone MGC: 3667, mRNA, complete cds. /FEA = mRNA /PROD = kallikrein 10 /DB_XREF = gi: 12803744 /UG = Hs.69423 kallikrein 10 /FL = gb: BC002710.1 | 209792_s_at |
| PCP4: Purkinje cell protein 4 (LOC5121) SEQ ID NOS: 95 (DNA) and 223 (amino acid) | gb: NM_006198.1 /DEF = *Homo sapiens* Purkinje cell protein 4 (PCP4), mRNA. /FEA = mRNA /GEN = PCP4 /PROD = Purkinje cell protein 4 /DB_XREF = gi: 5453857 /UG = Hs.80296 Purkinje cell protein 4 /FL = gb: U52969.1 gb: NM_006198.1 | 205549_at |
| NR4A2: nuclear receptor subfamily 4, group A, member 2 (LOC4929) SEQ ID NOS: 96 (DNA) and 224 (amino acid) | gb: NM_006186.1 /DEF = *Homo sapiens* nuclear receptor subfamily 4, group A, member 2 (NR4A2), mRNA. /FEA = mRNA /GEN = NR4A2 /PROD = nuclear receptor subfamily 4, group A, member 2 /DB_XREF = gi: 5453821 /UG = Hs.82120 nuclear receptor subfamily 4, group A, member 2 /FL = gb: NM_006186.1 | 204622_x_at |
| IGFBP3: insulin-like growth factor binding protein 3 (LOC3486) SEQ ID NOS: 97 (DNA) and 225 (amino acid) | gb: M31159.1 /DEF = Human growth hormone-dependent insulin-like growth factor-binding protein mRNA, complete cds. /FEA = mRNA /GEN = IGFBP1 /DB_XREF = gi: 183115 /UG = Hs.77326 insulin-like growth factor binding protein 3 /FL = gb: BC000013.1 gb: M31159.1 | 210095_s_at |
| STAT1: signal transducer and activator of transcription 1, 91 kDa (LOC6772) SEQ ID NOS: 98 (DNA) and 226 (amino acid) | gb: BC002704.1 /DEF = *Homo sapiens*, Similar to signal transducer and activator of transcription 1, 91 kD, clone MGC: 3493, mRNA, complete cds. /FEA = mRNA /PROD = Similar to signal transducer and activator oftranscription 1, 91 kD /DB_XREF = gi: 12803734 /UG = Hs.21486 signal transducer and activator of transcription 1, 91 kD /FL = gb: BC002704.1 | 209969_s_at |
| CYP1B1: cytochrome P450, family 1, subfamily B, polypeptide 1 (LOC1545) SEQ ID NOS: 99 (DNA) and 227 (amino acid) | Consensus includes gb: AU144855 /FEA = EST /DB_XREF = gi: 11006376 /DB_XREF = est: AU144855 /CLONE = HEMBA1003161 /UG = Hs.154654 cytochrome P450, subfamily I (dioxin-inducible), polypeptide 1 (glaucoma 3, primary infantile) /FL = gb: NM_000104.2 gb: U03688.1 | 202436_s_at |
| COL1A1: collagen, type I, alpha 1 (LOC1277) SEQ ID NOS: 100 (DNA) and 228 (amino acid) | Consensus includes gb: AI743621 /FEA = EST /DB_XREF = gi: 5111909 /DB_XREF = est: wg51h09.x1 /CLONE = IMAGE: 2368673 /UG = Hs.172928 collagen, type I, alpha 1 /FL = gb: NM_000088.1 | 202311_s_at |
| DKFZP434F0318: hypothetical protein DKFZp434F0318 (LOC81575) SEQ ID NOS: 101 (DNA) and 229 (amino acid) | gb: NM_030817.1 /DEF = *Homo sapiens* hypothetical protein DKFZp434F0318 (DKFZP434F0318), mRNA. /FEA = mRNA /GEN = DKFZP434F0318 /PROD = hypothetical protein DKFZp434F0318 | 221031_s_at |

TABLE 1-continued

Biomarkers

| Unigene title and SEQ ID NO: | Affymetrix Description | Affymetrix Probe Set |
|---|---|---|
| TUBA3: tubulin, alpha 3 (LOC7846) SEQ ID NOS: 102 (DNA) and 230 (amino acid) | /DB_XREF = gi: 13540611 /FL = gb: NM_030817.1 gb: AF141347.1 /DEF = *Homo sapiens* hum-a-tub2 alpha-tubulin mRNA, complete cds. /FEA = mRNA /PROD = alpha-tubulin /DB_XREF = gi: 4929133 /UG = Hs.272897 Tubulin, alpha, brain-specific /FL = gb: AF141347.1 gb: NM_006009.1 | 209118_s_at |
| GZMB: granzyme B (granzyme 2, cytotoxic T-lymphocyte-associated serine esterase 1) (LOC3002) SEQ ID NOS: 103 (DNA) and 231 (amino acid) | gb: J03189.1 /DEF = Human proteolytic serine esterase-like protein (SECT) gene, complete cds. /FEA = mRNA /DB_XREF = gi: 338010 /UG = Hs.1051 granzyme B (granzyme 2, cytotoxic T-lymphocyte-associated serine esterase 1) /FL = gb: J04071.1 gb: J03189.1 gb: M17016.1 gb: NM_004131.2 | 210164_at |
| ROBO1: roundabout, axon guidance receptor, homolog 1 (*Drosophila*) (LOC6091) SEQ ID NOS: 104 (DNA) and 232 (amino acid) | Consensus includes gb: BF059159 /FEA = EST /DB_XREF = gi: 10813055 /DB_XREF = est: 7k66g04.x1 /CLONE = IMAGE: 3480391 /UG = Hs.301198 roundabout (axon guidance receptor, *Drosophila*) homolog 1 /FL = gb: AF040990.1 gb: NM_002941.1 | 213194_at |
| CHGA: chromogranin A (parathyroid secretory protein 1) (LOC1113) SEQ ID NOS: 105 (DNA) and 233 (amino acid) | gb: NM_001275.2 /DEF = *Homo sapiens* chromogranin A (parathyroid secretory protein 1) (CHGA), mRNA. /FEA = mRNA /GEN = CHGA /PROD = chromogranin A /DB_XREF = gi: 10800418 /UG = Hs.172216 chromogranin A (parathyroid secretory protein 1) /FL = gb: NM_001275.2 gb: BC001059.1 gb: J03483.1 gb: J03915.1 | 204697_s_at |
| SLC7A8: solute carrier family 7 (cationic amino acid transporter, y+ system), member 8 (LOC23428) SEQ ID NOS: 106 (DNA) and 234 (amino acid) | gb: NM_012244.1 /DEF = *Homo sapiens* solute carrier family 7 (cationic amino acid transporter, y+ system), member 8 (SLC7A8), mRNA. /FEA = mRNA /GEN = SLC7A8 /PROD = solute carrier family 7 (cationic amino acidtransporter, y+ system), member 8 /DB_XREF = gi: 6912669 /UG = Hs.22891 solute carrier family 7 (cationic amino acid transporter, y+ system), member 8 /FL = gb: AB037669.1 gb: AF171669.1 gb: NM_012244.1 | 202752_x_at |
| GPA33: glycoprotein A33 (transmembrane) (LOC10223) SEQ ID NOS: 107 (DNA) and 235 (amino acid) | gb: NM_005814.1 /DEF = *Homo sapiens* glycoprotein A33 (transmembrane) (GPA33), mRNA. /FEA = mRNA /GEN = GPA33 /PROD = transmembrane glycoprotein A33 precursor /DB_XREF = gi: 5031560 /UG = Hs.143131 glycoprotein A33 (transmembrane) /FL = gb: U79725.1 gb: NM_005814.1 | 205929_at |
| QPRT: quinolinate phosphoribosyltransferase (nicotinate-nucleotide pyrophosphorylase (carboxylating)) (LOC23475) SEQ ID NOS: 108 (DNA) and 236 (amino acid) | gb: NM_014298.2 /DEF = *Homo sapiens* quinolinate phosphoribosyltransferase (nicotinate-nucleotide pyrophosphorylase (carboxylating)) (QPRT), mRNA. /FEA = mRNA /GEN = QPRT /PROD = quinolinate phosphoribosyltransferase /DB_XREF = gi: 9257236 /UG = Hs.8935 quinolinate phosphoribosyltransferase (nicotinate-nucleotide pyrophosphorylase (carboxylating)) /FL = gb: D78177.1 gb: BC005060.1 gb: NM_014298.2 | 204044_at |
| DDC: dopa decarboxylase (aromatic L-amino acid decarboxylase) (LOC1644) | gb: NM_000790.1 /DEF = *Homo sapiens* dopa decarboxylase (aromatic L-amino acid decarboxylase) (DDC), mRNA. | 205311_at |

TABLE 1-continued

Biomarkers

| Unigene title and SEQ ID NO: | Affymetrix Description | Affymetrix Probe Set |
|---|---|---|
| SEQ ID NOS: 109 (DNA) and 237 (amino acid) | /FEA = mRNA /GEN = DDC /PROD = dopa decarboxylase (aromatic L-amino aciddecarboxylase) /DB_XREF = gi: 4503280 /UG = Hs.150403 dopa decarboxylase (aromatic L-amino acid decarboxylase) /FL = gb: BC000485.1 gb: M76180.1 gb: M88700.1 gb: NM_000790.1 | |
| COL11A1: collagen, type XI, alpha 1 (LOC1301) SEQ ID NOS: 110 (DNA) and 238 (amino acid) | gb: NM_001854.1 /DEF = *Homo sapiens* collagen, type XI, alpha 1 (COL11A1), mRNA. /FEA = mRNA /GEN = COL11A1 /PROD = collagen, type XI, alpha 1 /DB_XREF = gi: 4502938 /UG = Hs.82772 collagen, type XI, alpha 1 /FL = gb: J04177.1 gb: NM_001854.1 | 204320_at |
| C2orf23: chromosome 2 open reading frame 23 (LOC65055) SEQ ID NOS: 111 (DNA) and 239 (amino acid) | Consensus includes gb: BE535746 /FEA = EST /DB_XREF = gi: 9764391 /DB_XREF = est: 601060419F1 /CLONE = IMAGE: 3446788 /UG = Hs.7358 hypothetical protein FLJ13110 /FL = gb: NM_022912.1 | 204364_s_at |
| SULF1: sulfatase 1 (LOC23213) SEQ ID NOS: 112 (DNA) and 240 (amino acid) | Consensus includes gb: BE500977 /FEA = EST /DB_XREF = gi: 9703385 /DB_XREF = est: 7a33h02.x1 /CLONE = IMAGE: 3220563 /UG = Hs.70823 KIAA1077 protein | 212354_at |
| PCOLCE: procollagen C-endopeptidase enhancer (LOC5118) SEQ ID NOS: 113 (DNA) and 241 (amino acid) | gb: NM_002593.2 /DEF = *Homo sapiens* procollagen C-endopeptidase enhancer (PCOLCE), mRNA. /FEA = mRNA /GEN = PCOLCE /PROD = procollagen C-endopeptidase enhancer /DB_XREF = gi: 7262388 /UG = Hs.202097 procollagen C-endopeptidase enhancer /FL = gb: BC000574.1 gb: AB008549.1 gb: L33799.1 gb: NM_002593.2 | 202465_at |
| C14orf78: chromosome 14 open reading frame 78 (LOC113146) SEQ ID NOS: 114 (DNA) and 242 (amino acid) | Consensus includes gb: AI935123 /FEA = EST /DB_XREF = gi: 5673993 /DB_XREF = est: wp13h09.x1 /CLONE = IMAGE: 2464769 /UG = Hs.57548 ESTs | 212992_at |
| CXCR4: chemokine (C—X—C motif) receptor 4 (LOC7852) SEQ ID NOS: 115 (DNA) and 243 (amino acid) | gb: L01639.1 /DEF = Human (clone HSY3RR) neuropeptide Y receptor (NPYR) mRNA, complete cds. /FEA = mRNA /GEN = NPYR /PROD = neuropeptide Y receptor /DB_XREF = gi: 189313 /UG = Hs.89414 chemokine (C—X—C motif), receptor 4 (fusin) /FL = gb: L01639.1 gb: AF025375.1 gb: M99293.1 gb: L06797.1 gb: NM_003467.1 gb: AF147204.1 | 209201_x_at |
| CSPG2: chondroitin sulfate proteoglycan 2 (versican) (LOC1462) SEQ ID NOS: 116 (DNA) and 244 (amino acid) | Consensus includes gb: R94644 /FEA = EST /DB_XREF = gi: 970039 /DB_XREF = est: yq42a12.r1 /CLONE = IMAGE: 198430 /UG = Hs.306542 *Homo sapiens* versican Vint isoform, mRNA, partial cds | 215646_s_at |
| SERPINF1: serine (or cysteine) proteinase inhibitor, clade F (alpha-2 antiplasmin, pigment epithelium derived factor), member 1 (LOC5176) SEQ ID NOS: 117 (DNA) and 245 (amino acid) | gb: NM_002615.1 /DEF = *Homo sapiens* serine (or cysteine) proteinase inhibitor, clade F (alpha-2 antiplasmin, pigment epithelium derived factor), member 1 (SERPINF1), mRNA. /FEA = mRNA /GEN = SERPINF1 /PROD = serine (or cysteine) proteinase inhibitor, cladeF (alpha-2 antiplasmin, pigment epithelium derivedfactor), member 1 /DB_XREF = gi: 4505708 /UG = Hs.173594 serine (or cysteine) proteinase inhibitor, clade F (alpha-2 antiplasmin, pigment epithelium derived factor), member 1 | 202283_at |

TABLE 1-continued

Biomarkers

| Unigene title and SEQ ID NO: | Affymetrix Description | Affymetrix Probe Set |
|---|---|---|
| SPON1: spondin 1, extracellular matrix protein (LOC10418) SEQ ID NOS: 118 (DNA) and 246 (amino acid) | /FL = gb: M90439.1 gb: BC000522.1 gb: M76979.1 gb: NM_002615.1 Consensus includes gb: AB018305.1 /DEF = *Homo sapiens* mRNA for KIAA0762 protein, partial cds. /FEA = mRNA /GEN = KIAA0762 /PROD = KIAA0762 protein /DB_XREF = gi: 3882244 /UG = Hs.5378 spondin 1, (f-spondin) extracellular matrix protein /FL = gb: AB051390.1 | 209436_at |
| COL11A1: collagen, type XI, alpha 1 (LOC1301) SEQ ID NOS: 119 (DNA) and 247 (amino acid) | Cluster Incl. J04177: Human alpha-1 type XI collagen (COL11A1) mRNA, complete cds /cds = (161,5581) /gb = J04177 /gi = 179729 /ug = Hs.82772 /len = 6158 | 37892_at |
| MAFB: v-maf musculoaponeurotic fibrosarcoma oncogene homolog B (avian) (LOC9935) SEQ ID NOS: 120 (DNA) and 248 (amino acid) | gb: NM_005461.1 /DEF = *Homo sapiens* Kreisler (mouse) maf-related leucine zipper homolog (KRML), mRNA. /FEA = mRNA /GEN = KRML /PROD = Kreisler (mouse) maf-related leucine zipperhomolog /DB_XREF = gi: 4885446 /UG = Hs.169487 Kreisler (mouse) maf-related leucine zipper homolog /FL = gb: AF134157.1 gb: NM_005461.1 | 218559_s_at |
| DDX17: DEAD (Asp-Glu-Ala-Asp) box polypeptide 17 (LOC10521) SEQ ID NOS: 121 (DNA) and 249 (amino acid) | Consensus includes gb: AW188131 /FEA = EST /DB_XREF = gi: 6462567 /DB_XREF = est: xj92f11.x1 /CLONE = IMAGE: 2664717 /UG = Hs.6179 DEADH (Asp-Glu-Ala-AspHis) box polypeptide 17 (72 kD) | 213998_s_at |
| PHLDA1: pleckstrin homology-like domain, family A, member 1 (LOC22822) SEQ ID NOS: 122 (DNA) and 250 (amino acid) | Consensus includes gb: NM_007350.1 /DEF = *Homo sapiens* pleckstrin homology-like domain, family A, member 1 (PHLDA1), mRNA. /FEA = mRNA /GEN = PHLDA1 /PROD = pleckstrin homology-like domain, family A, member 1 /DB_XREF = gi: 6679302 /UG = Hs.82101 pleckstrin homology-like domain, family A, member 1 /FL = gb: NM_007350.1 | 217999_s_at |
| ETV5: ets variant gene 5 (ets-related molecule) (LOC2119) SEQ ID NOS: 123 (DNA) and 251 (amino acid) | gb: NM_004454.1 /DEF = *Homo sapiens* ets variant gene 5 (ets-related molecule) (ETV5), mRNA. /FEA = mRNA /GEN = ETV5 /PROD = ets variant gene 5 (ets-related molecule) /DB_XREF = gi: 4758315 /UG = Hs.43697 ets variant gene 5 (ets-related molecule) /FL = gb: NM_004454.1 | 203349_s_at |
| DUSP4: dual specificity phosphatase 4 (LOC1846) SEQ ID NOS: 124 (DNA) and 252 (amino acid) | gb: BC002671.1 /DEF = *Homo sapiens*, dual specificity phosphatase 4, clone MGC: 3713, mRNA, complete cds. /FEA = mRNA /PROD = dual specificity phosphatase 4 /DB_XREF = gi: 12803670 /UG = Hs.2359 dual specificity phosphatase 4 /FL = gb: U48807.1 gb: NM_001394.2 gb: BC002671.1 gb: U21108.1 | 204015_s_at |
| DUSP4: dual specificity phosphatase 4 (LOC1846) SEQ ID NOS: 125 (DNA) and 253 (amino acid) | gb: NM_001394.2 /DEF = *Homo sapiens* dual specificity phosphatase 4 (DUSP4), mRNA. /FEA = mRNA /GEN = DUSP4 /PROD = dual specificity phosphatase 4 /DB_XREF = gi: 12707552 /UG = Hs.2359 dual specificity phosphatase 4 /FL = gb: U48807.1 gb: NM_001394.2 gb: BC002671.1 gb: U21108.1 | 204014_at |
| POFUT1: protein O-fucosyltransferase 1 (LOC23509) | Consensus includes gb: AL045513 /FEA = EST /DB_XREF = gi: 5433649 /DB_XREF = est: DKFZp434J015_r1 | 212349_at |

TABLE 1-continued

Biomarkers

| Unigene title and SEQ ID NO: | Affymetrix Description | Affymetrix Probe Set |
|---|---|---|
| SEQ ID NOS: 126 (DNA) and 254 (amino acid) TBXAS1: thromboxane A synthase 1 (platelet, cytochrome P450, family 5, subfamily A) (LOC6916) SEQ ID NOS: 127 (DNA) and 255 (amino acid) | /CLONE = DKFZp434J015 /UG = Hs.178292 KIAA0180 protein gb: NM_030984.1 /DEF = *Homo sapiens* thromboxane A synthase 1 (platelet, cytochrome P450, subfamily V) (TBXAS1), transcript variant TXS-II, mRNA. /FEA = mRNA /GEN = TBXAS1 /PROD = thromboxane A synthase 1 (platelet, cytochromeP450, subfamily V), isoform TXS-II /DB_XREF = gi: 13699839 /FL = gb: NM_030984.1 | 208130_s_at |
| KCNK5: potassium channel, subfamily K, member 5 (LOC8645) SEQ ID NOS: 128 (DNA) and 256 (amino acid) | gb: NM_003740.1 /DEF = *Homo sapiens* potassium channel, subfamily K, member 5 (TASK-2) (KCNK5), mRNA. /FEA = mRNA /GEN = KCNK5 /PROD = potassium channel, subfamily K, member 5(TASK-2) /DB_XREF = gi: 4504850 /UG = Hs.127007 potassium channel, subfamily K, member 5 (TASK-2) /FL = gb: AF084830.1 gb: NM_003740.1 | 219615_s_at |

The biomarkers provided in Table 1, which include the nucleotide sequences of SEQ ID NOS:1-128 and the amino acid sequences of SEQ ID NOS:129-256, are referred to herein as a total of 128 biomarkers with reference to the Unigene Title.

The biomarkers have expression levels in cells that may be dependent on the activity of the EGFR signal transduction pathway, and that are also highly correlated with EGFR modulator sensitivity exhibited by the cells. Biomarkers serve as useful molecular tools for predicting the likelihood of a response to EGFR modulators, preferably biological molecules, small molecules, and the like that affect EGFR kinase activity via direct or indirect inhibition or antagonism of EGFR kinase function or activity.

Wild Type K-Ras and Mutated K-Ras

As used herein, wild type K-Ras can be selected from the K-Ras variant a and variant b nucleotide and amino acid sequences. Wild type K-Ras variant a has a nucleotide sequence that is 5436 nucleotides (GenBank Accession No. NM_033360.2) and encodes a protein that is 189 amino acids (GenBank Accession No. NP_203524.1). Wild type K-Ras variant b has a nucleotide sequence that is 5312 nucleotides (GenBank Accession No. NM_004985.3) and encodes a protein that is 188 amino acids (GenBank Accession No. NP_004976.2).

A mutated form of K-Ras is a nucleotide or amino acid sequence that differs from wild type K-Ras at least at one position, preferably at least one nucleotide position that encodes an amino acid that differs from wild type K-Ras. In one aspect, the mutated form of K-Ras includes at least one mutation in exon 2. In another aspect, the mutated form of K-RAS includes at least one of the following mutations in exon 2 (base change (amino acid change)): 200G>A (V7M); 216G>C (G12A); 215G>T (G12C); 216G>A (G12D); 215G>C (G12R); 215G>A (G12S); 216G>T (G12V); 218G>T (G13C); 219G>A (G13D).

Methods for detecting K-Ras mutations are well known in the art and include, for example, the methods described in PCT Publication No. Wo2005/118876.

EGFR Modulators

As used herein, the term "EGFR modulator" is intended to mean a compound or drug that is a biological molecule or a small molecule that directly or indirectly modulates EGFR activity or the EGFR signal transduction pathway. Thus, compounds or drugs as used herein is intended to include both small molecules and biological molecules. Direct or indirect modulation includes activation or inhibition of EGFR activity or the EGFR signal transduction pathway. In one aspect, inhibition refers to inhibition of the binding of EGFR to an EGFR ligand such as, for example, EGF. In another aspect, inhibition refers to inhibition of the kinase activity of EGFR.

EGFR modulators include, for example, EGFR-specific ligands, small molecule EGFR inhibitors, and EGFR monoclonal antibodies. In one aspect, the EGFR modulator inhibits EGFR activity and/or inhibits the EGFR signal transduction pathway. In another aspect, the EGFR modulator is an EGFR monoclonal antibody that inhibits EGFR activity and/or inhibits the EGFR signal transduction pathway.

EGFR modulators include biological molecules or small molecules. Biological molecules include all lipids and polymers of monosaccharides, amino acids, and nucleotides having a molecular weight greater than 450. Thus, biological molecules include, for example, oligosaccharides and polysaccharides; oligopeptides, polypeptides, peptides, and proteins; and oligonucleotides and polynucleotides. Oligonucleotides and polynucleotides include, for example, DNA and RNA.

Biological molecules further include derivatives of any of the molecules described above. For example, derivatives of biological molecules include lipid and glycosylation derivatives of oligopeptides, polypeptides, peptides, and proteins.

Derivatives of biological molecules further include lipid derivatives of oligosaccharides and polysaccharides, e.g., lipopolysaccharides. Most typically, biological molecules are antibodies, or functional equivalents of antibodies. Functional equivalents of antibodies have binding characteristics comparable to those of antibodies, and inhibit the growth of cells that express EGFR. Such functional equivalents include, for example, chimerized, humanized, and single chain antibodies as well as fragments thereof.

Functional equivalents of antibodies also include polypeptides with amino acid sequences substantially the same as the amino acid sequence of the variable or hypervariable regions of the antibodies. An amino acid sequence that is substantially the same as another sequence, but that differs from the other sequence by means of one or more substitutions, additions, and/or deletions, is considered to be an equivalent sequence. Preferably, less than 50%, more preferably less than 25%, and still more preferably less than 10%, of the number of amino acid residues in a sequence are substituted for, added to, or deleted from the protein.

The functional equivalent of an antibody is preferably a chimerized or humanized antibody. A chimerized antibody comprises the variable region of a non-human antibody and the constant region of a human antibody. A humanized antibody comprises the hypervariable region (CDRs) of a non-human antibody. The variable region other than the hypervariable region, e.g., the framework variable region, and the constant region of a humanized antibody are those of a human antibody.

Suitable variable and hypervariable regions of non-human antibodies may be derived from antibodies produced by any non-human mammal in which monoclonal antibodies are made. Suitable examples of mammals other than humans include, for example, rabbits, rats, mice, horses, goats, or primates.

Functional equivalents further include fragments of antibodies that have binding characteristics that are the same as, or are comparable to, those of the whole antibody. Suitable fragments of the antibody include any fragment that comprises a sufficient portion of the hypervariable (i.e., complementarity determining) region to bind specifically, and with sufficient affinity, to EGFR tyrosine kinase to inhibit growth of cells that express such receptors.

Such fragments may, for example, contain one or both Fab fragments or the F(ab')$_2$ fragment. Preferably, the antibody fragments contain all six complementarity determining regions of the whole antibody, although functional fragments containing fewer than all of such regions, such as three, four, or five CDRs, are also included.

In one aspect, the fragments are single chain antibodies, or Fv fragments. Single chain antibodies are polypeptides that comprise at least the variable region of the heavy chain of the antibody linked to the variable region of the light chain, with or without an interconnecting linker. Thus, Fv fragment comprises the entire antibody combining site. These chains may be produced in bacteria or in eukaryotic cells.

The antibodies and functional equivalents may be members of any class of immunoglobulins, such as IgG, IgM, IgA, IgD, or IgE, and the subclasses thereof. In one aspect, the antibodies are members of the IgG1 subclass. The functional equivalents may also be equivalents of combinations of any of the above classes and subclasses.

In one aspect, EGFR antibodies can be selected from chimerized, humanized, fully human, and single chain antibodies derived from the murine antibody 225 described in U.S. Pat. No. 4,943,533.

In another aspect, the EGFR antibody is cetuximab (IMC-C225) which is a chimeric (human/mouse) IgG monoclonal antibody, also known under the tradename ERBITUX. Cetuximab Fab contains the Fab fragment of cetuximab, i.e., the heavy and light chain variable region sequences of murine antibody M225 (U.S. Application No. 2004/0006212, incorporated herein by reference) with human IgG1 $C_H1$ heavy and kappa light chain constant domains. Cetuximab includes all three IgG1 heavy chain constant domains.

In another aspect, the EGFR antibody can be selected from the antibodies described in U.S. Pat. No. 6,235,883, U.S. Pat. No. 5,558,864, and U.S. Pat. No. 5,891,996. The EGFR antibody can be, for example, AGX-EGF (Amgen Inc.) (also known as panitumumab) which is a fully human IgG2 monoclonal antibody. The sequence and characterization of ABX-EGF, which was formerly known as clone E7.6.3, is disclosed in U.S. Pat. No. 6,235,883 at column 28, line 62 through column 29, line 36 and FIGS. 29-34, which is incorporated by reference herein. The EGFR antibody can also be, for example, EMD72000 (Merck KGaA), which is a humanized version of the murine EGFR antibody EMD 55900. The EGFR antibody can also be, for example: h-R3 (TheraCIM), which is a humanized EGFR monoclonal antibody; Y10 which is a murine monoclonal antibody raised against a murine homologue of the human EGFRvIII mutation; or MDX-447 (Medarex Inc.).

In addition to the biological molecules discussed above, the EGFR modulators useful in the invention may also be small molecules. Any molecule that is not a biological molecule is considered herein to be a small molecule. Some examples of small molecules include organic compounds, organometallic compounds, salts of organic and organometallic compounds, saccharides, amino acids, and nucleotides. Small molecules further include molecules that would otherwise be considered biological molecules, except their molecular weight is not greater than 450. Thus, small molecules may be lipids, oligosaccharides, oligopeptides, and oligonucleotides and their derivatives, having a molecular weight of 450 or less.

It is emphasized that small molecules can have any molecular weight. They are merely called small molecules because they typically have molecular weights less than 450. Small molecules include compounds that are found in nature as well as synthetic compounds. In one embodiment, the EGFR modulator is a small molecule that inhibits the growth of tumor cells that express EGFR. In another embodiment, the EGFR modulator is a small molecule that inhibits the growth of refractory tumor cells that express EGFR.

Numerous small molecules have been described as being useful to inhibit EGFR.

One example of a small molecule EGFR antagonist is ERESSA (ZD1939), which is a quinozaline derivative that functions as an ATP-mimetic to inhibit EGFR. See, U.S. Pat. No. 5,616,582; WO 96/33980 at page 4. Another example of a small molecule EGFR antagonist is TARCEVA (OSI-774), which is a 4-(substitutedphenylamino)quinozaline derivative [6,7-Bis(2-methoxy-ethoxy)-quinazolin-4-yl]-(3-ethynyl-1-phenyl)amine hydrochloride] EGFR inhibitor. See WO 96/30347 (Pfizer Inc.) at, for example, page 2, line 12 through page 4, line 34 and page 19, lines 14-17. TARCEVA may function by inhibiting phosphorylation of EGFR and its downstream PI3/Akt and MAP (mitogen activated protein) kinase signal transduction pathways resulting in p27-mediated cell-cycle arrest. See Hidalgo et al., Abstract 281 presented at the 37th Annual Meeting of ASCO, San Francisco, Calif., 12-15 May 2001.

Other small molecules are also reported to inhibit EGFR, many of which are thought to be specific to the tyrosine kinase domain of an EGFR. Some examples of such small molecule EGFR antagonists are described in WO 91/116051, WO96/30347, WO96/33980, WO97/27199. WO97/30034, WO97/42187, WO97/49688, WO98/33798, WO00/18761, and WO00/31048. Examples of specific small molecule EGFR antagonists include C1-1033 (Pfizer Inc.), which is a quinozaline (N-[4-(3-chloro-4-fluoro-phenylamino)-7-(3-mprpholin-4-yl-propoxy)-quinazolin-6-yl]-acrylamide) inhibitor of tyrosine kinases, particularly EGFR and is described in WO00/31048 at page 8, lines 22-6; PKI166 (Novartis), which is a pyrrolopyrimidine inhibitor of EGFR and is described in WO97/27199 at pages 10-12; GW2016 (GlaxoSmithKline), which is an inhibitor of EGFR and HER2; EKB569 (Wyeth), which is reported to inhibit the growth of tumor cells that overexpress EGFR or HER2 in vitro and in vivo; AG-1478 (Tryphostin), which is a quinazoline small molecule that inhibits signaling from both EGFR and erbB-2; AG-1478 (Sugen), which is a bisubstrate inhibitor that also inhibits protein kinase CK2; PD 153035 (Parke-Davis) which is reported to inhibit EGFR kinase activity and tumor growth, induce apoptosis in cells in culture, and enhance the cytotoxicity of cytotoxic chemotherapeutic agents; SPM-924 (Schwarz Pharma), which is a tyrosine kinase inhibitor targeted for treatment of prostrate cancer; CP-546,989 (OSI Pharmaceuticals), which is reportedly an inhibitor of angiogenesis for treatment of solid tumors; ADL-681, which is a EGFR kinase inhibitor targeted for treatment of cancer; PD 158780, which is a pyridopyrimidine that is reported to inhibit the tumor growth rate of A4431 xenografts in mice; CP-358,774, which is a quinzoline that is reported to inhibit autophosphorylation in HN5 xenografts in mice; ZD1839, which is a quinoline that is reported to have antitumor activity in mouse xenograft models including vulvar, NSCLC, prostrate, ovarian, and colorectal cancers; CGP 59326A, which is a pyrrolopyrimidine that is reported to inhibit growth of EGFR-positive xenografts in mice; PD 165557 (Pfizer); CGP54211 and CGP53353 (Novartis), which are dianilnophthalimides. Naturally derived EGFR tyrosine kinase inhibitors include genistein, herbimycin A, quercetin, and erbstatin.

Further small molecules reported to inhibit EGFR and that are therefore within the scope of the present invention are tricyclic compounds such as the compounds described in U.S. Pat. No. 5,679,683; quinazoline derivatives such as the derivatives described in U.S. Pat. No. 5,616,582; and indole compounds such as the compounds described in U.S. Pat. No. 5,196,446.

Further small molecules reported to inhibit EGFR and that are therefore within the scope of the present invention are styryl substituted heteroaryl compounds such as the compounds described in U.S. Pat. No. 5,656,655. The heteroaryl group is a monocyclic ring with one or two heteroatoms, or a bicyclic ring with 1 to about 4 heteroatoms, the compound being optionally substituted or polysubstituted.

Further small molecules reported to inhibit EGFR and that are therefore within the scope of the present invention are bis mono and/or bicyclic aryl heteroaryl, carbocyclic, and heterocarbocyclic compounds described in U.S. Pat. No. 5,646,153.

Further small molecules reported to inhibit EGFR and that are therefore within the scope of the present invention is the compound provided FIG. 1 of Fry et al., Science 265, 1093-1095 (1994) that inhibits EGFR.

Further small molecules reported to inhibit EGFR and that are therefore within the scope of the present invention are tyrphostins that inhibit EGFR/HER1 and HER 2, particularly those in Tables I, II, III, and IV described in Osherov et al., J. Biol. Chem., 25; 268(15):11134-42 (1993).

Further small molecules reported to inhibit EGFR and that are therefore within the scope of the present invention is a compound identified as PD166285 that inhibits the EGFR, PDGFR, and FGFR families of receptors. PD166285 is identified as 6-(2,6-dichlorophenyl)-2-(4-(2-diethylaminoethyoxy)phenylamino)-8-methyl-8H-pyrido(2,3-d)pyrimidin-7-one having the structure shown in FIG. 1 on page 1436 of Panek et al., Journal of Pharmacology and Experimental Therapeutics 283, 1433-1444 (1997).

It should be appreciated that useful small molecule to be used in the invention are inhibitors of EGFR, but need not be completely specific for EGFR.

Biomarkers and Biomarker Sets

The invention includes individual biomarkers and biomarker sets having both diagnostic and prognostic value in disease areas in which signaling through EGFR or the EGFR pathway is of importance, e.g., in cancers or tumors, in immunological disorders, conditions or dysfunctions, or in disease states in which cell signaling and/or cellular proliferation controls are abnormal or aberrant. The biomarker sets comprise a plurality of biomarkers such as, for example, a plurality of the biomarkers provided in Table 1, that highly correlate with resistance or sensitivity to one or more EGFR modulators.

The biomarkers and biomarker sets of the invention enable one to predict or reasonably foretell the likely effect of one or more EGFR modulators in different biological systems or for cellular responses. The biomarkers and biomarker sets can be used in in vitro assays of EGFR modulator response by test cells to predict in vivo outcome. In accordance with the invention, the various biomarkers and biomarker sets described herein, or the combination of these biomarker sets with other biomarkers or markers, can be used, for example, to predict how patients with cancer might respond to therapeutic intervention with one or more EGFR modulators.

A biomarker and biomarker set of cellular gene expression patterns correlating with sensitivity or resistance of cells following exposure of the cells to one or more EGFR modulators provides a useful tool for screening one or more tumor samples before treatment with the EGFR modulator. The screening allows a prediction of cells of a tumor sample exposed to one or more EGFR modulators, based on the expression results of the biomarker and biomarker set, as to whether or not the tumor, and hence a patient harboring the tumor, will or will not respond to treatment with the EGFR modulator.

The biomarker or biomarker set can also be used as described herein for monitoring the progress of disease treatment or therapy in those patients undergoing treatment for a disease involving an EGFR modulator.

The biomarkers also serve as targets for the development of therapies for disease treatment. Such targets may be particularly applicable to treatment of colorectal cancer. Indeed, because these biomarkers are differentially expressed in sensitive and resistant cells, their expression patterns are correlated with relative intrinsic sensitivity of cells to treatment with EGFR modulators. Accordingly, the biomarkers highly expressed in resistant cells may serve as targets for the development of new therapies for the tumors which are resistant to EGFR modulators, particularly EGFR inhibitors.

The level of biomarker protein and/or mRNA can be determined using methods well known to those skilled in the art. For example, quantification of protein can be carried out using methods such as ELISA, 2-dimensional SDS PAGE, Western blot, immunopreciptation, immunohistochemistry, fluorescence activated cell sorting (FACS), or flow cytometry. Quantification of mRNA can be carried out using methods such as PCR, array hybridization, Northern blot, in-situ hybridization, dot-blot, Taqman, or RNAse protection assay.

Microarrays

The invention also includes specialized microarrays, e.g., oligonucleotide microarrays or cDNA microarrays, comprising one or more biomarkers, showing expression profiles that correlate with either sensitivity or resistance to one or more EGFR modulators. Such microarrays can be employed in in vitro assays for assessing the expression level of the biomarkers in the test cells from tumor biopsies, and determining whether these test cells are likely to be resistant or sensitive to EGFR modulators. For example, a specialized microarray can be prepared using all the biomarkers, or subsets thereof, as described herein and shown in Table 1. Cells from a tissue or organ biopsy can be isolated and exposed to one or more of the EGFR modulators. In one aspect, following application of nucleic acids isolated from both untreated and treated cells to one or more of the specialized microarrays, the pattern of gene expression of the tested cells can be determined and compared with that of the biomarker pattern from the control panel of cells used to create the biomarker set on the microarray. Based upon the gene expression pattern results from the cells that underwent testing, it can be determined if the cells show a resistant or a sensitive profile of gene expression. Whether or not the tested cells from a tissue or organ biopsy will respond to one or more of the EGFR modulators and the course of treatment or therapy can then be determined or evaluated based on the information gleaned from the results of the specialized microarray analysis.

Antibodies

The invention also includes antibodies, including polyclonal or monoclonal, directed against one or more of the polypeptide biomarkers. Such antibodies can be used in a variety of ways, for example, to purify, detect, and target the biomarkers of the invention, including both in vitro and in vivo diagnostic, detection, screening, and/or therapeutic methods.

Kits

The invention also includes kits for determining or predicting whether a patient would be susceptible or resistant to a treatment that comprises one or more EGFR modulators. The patient may have a cancer or tumor such as, for example, colorectal cancer. Such kits would be useful in a clinical setting for use in testing a patient's biopsied tumor or other cancer samples, for example, to determine or predict if the patient's tumor or cancer will be resistant or sensitive to a given treatment or therapy with an EGFR modulator. The kit comprises a suitable container that comprises: one or more microarrays, e.g., oligonucleotide microarrays or cDNA microarrays, that comprise those biomarkers that correlate with resistance and sensitivity to EGFR modulators, particularly EGFR inhibitors; one or more EGFR modulators for use in testing cells from patient tissue specimens or patient samples; and instructions for use. In addition, kits contemplated by the invention can further include, for example, reagents or materials for monitoring the expression of biomarkers of the invention at the level of mRNA or protein, using other techniques and systems practiced in the art such as, for example, RT-PCR assays, which employ primers designed on the basis of one or more of the biomarkers described herein, immunoassays, such as enzyme linked immunosorbent assays (ELISAs), immunoblotting, e.g., Western blots, or in situ hybridization, and the like.

Application of Biomarkers and Biomarker Sets

The biomarkers and biomarker sets may be used in different applications. Biomarker sets can be built from any combination of biomarkers listed in Table 1 to make predictions about the effect of an EGFR modulator in different biological systems. The various biomarkers and biomarkers sets described herein can be used, for example, as diagnostic or prognostic indicators in disease management, to predict how patients with cancer might respond to therapeutic intervention with compounds that modulate the EGFR, and to predict how patients might respond to therapeutic intervention that modulates signaling through the entire EGFR regulatory pathway.

The biomarkers have both diagnostic and prognostic value in diseases areas in which signaling through EGFR or the EGFR pathway is of importance, e.g., in immunology, or in cancers or tumors in which cell signaling and/or proliferation controls have gone awry.

In one aspect, cells from a patient tissue sample, e.g., a tumor or cancer biopsy, can be assayed to determine the expression pattern of one or more biomarkers prior to treatment with one or more EGFR modulators. In one aspect, the tumor or cancer is colorectal. Success or failure of a treatment can be determined based on the biomarker expression pattern of the cells from the test tissue (test cells), e.g., tumor or cancer biopsy, as being relatively similar or different from the expression pattern of a control set of the one or more biomarkers. Thus, if the test cells show a biomarker expression profile which corresponds to that of the biomarkers in the control panel of cells which are sensitive to the EGFR modulator, it is highly likely or predicted that the individual's cancer or tumor will respond favorably to treatment with the EGFR modulator. By contrast, if the test cells show a biomarker expression pattern corresponding to that of the biomarkers of the control panel of cells which are resistant to the EGFR modulator, it is highly likely or predicted that the individual's cancer or tumor will not respond to treatment with the EGFR modulator.

The invention also provides a method of monitoring the treatment of a patient having a disease treatable by one or more EGFR modulators. The isolated test cells from the patient's tissue sample, e.g., a tumor biopsy or tumor sample, can be assayed to determine the expression pattern of one or more biomarkers before and after exposure to an EGFR modulator wherein, preferably, the EGFR modulator is an EGFR inhibitor. The resulting biomarker expression profile of the test cells before and after treatment is compared with that of one or more biomarkers as described and shown herein to be highly expressed in the control panel of cells that are either resistant or sensitive to an EGFR modulator. Thus, if a patient's response is sensitive to treatment by an EGFR modulator, based on correlation of the expression profile of the one or biomarkers, the patient's treatment prognosis can be qualified as favorable and treatment can continue. Also, if, after treatment with an EGFR modulator, the test cells don't show a change in the biomarker expression profile corresponding to the control panel of cells that are sensitive to the EGFR modulator, it can serve as an indicator that the current treatment should be modified, changed, or even discontinued. This monitoring process can indicate success or failure of a patient's treatment with an EGFR modulator and such monitoring processes can be repeated as necessary or desired.

EXAMPLES

Example 1

Interim Analysis Identification of Biomarkers

The CA225-045 pharmacogenomics trial is a phase II randomized exploratory study of ERBITUX (cetuximab) monotherapy in patients with refractory metastatic colorectal cancer (mCRC). An interim analysis of data from samples obtained from this trial was performed to examine the preclinically discovered markers in the clinical samples and to identify response prediction markers de novo.

Clinical Samples:

49 RNA patient samples isolated from pre-treatment tumor biopsies of the metastatic site were randomized into five blocks and profiled on U133A v2.0 chips (Affymetrix, Santa Clara, Calif.). Profiling data from 30/49 patients were included in the analysis based on meeting the following criteria: completion of at least two cycles of therapy; availability of sufficient clinical data to evaluate response; presence of tumor cells in biopsy sample; and good quality profiling data from chip.

The 30 patient expression profiles consisted of 24 liver metastases and 6 other tissue types. The Best Clinical Response information from the 30 patients identified 4 partial responders (PR), 5 stable disease (SD) and 21 progressive disease (PD) patients. Assessment of response was performed according to a modified version of the World Health Organization (WHO) criteria (Miller et al., Cancer, 47: 207-214 (1981)). Overall response was determined based on evaluation of target, non-target, and new lesions. Partial response (PR) was defined as at least a 50% decrease in the sum of the product of diameters (SPD) of target lesions, taking as reference the baseline SPD. Progressive disease (PD) was defined as a 25% or greater increase in the SPD of target lesions, taking as reference the smallest SPD recorded since the treatment started or the appearance of new lesions. Stable disease (SD) was defined as neither sufficient shrinkage to qualify for PR nor sufficient increase to qualify for PD.

Gene Expression Profiling:

Pre-treatment biopsies were obtained from the metastatic site for RNA isolation. RNA was isolated from the pre-treatment biopsies using the RNeasy mini kit (Qiagen, Valencia, Calif.). The quality of RNA was checked by measuring the 28S:18S ribosomal RNA ratio using an Agilent 2100 Bioanalyzer (Agilent Technologies, Rockville, Md.). Concentration of total RNA was determined spectrophotometrically. 1 μg of total RNA was used to prepare biotinylated probes according to the Affymetrix Genechip Expression Analysis Technical Manual. Targets were hybridized to human HG-U133A v2.0 gene chips according to the manufacturer's instructions. Data were preprocessed using the MAS 5.0 software (Affymetrix, Santa Clara, Calif.).

Data Analysis:

Of the 22,215 probesets present on the U133A v2.0 chip, 17,261 probesets that had present calls in at least two liver metastatic tissues were included for data analysis. Data was analyzed by performing a two-sided unequal variance t test with Microsoft Excel or Anova analysis using PartekPro Pattern Recognition Software (Partek, St. Charles, Mo.). The statistical analyses were performed using MAS 5.0 quantile normalized values for signal intensity for 17,261 probe sets.

Analysis of Biomarkers Using T Test and ANOVA Analysis:

The first step was to examine 42 probesets that were identified preclinically (FIG. 1) in the transcriptional profiles of 30 metastatic tumors. This was done to examine whether the preclinical markers are differentially expressed between patients who derive clinical benefit (PR and SD) from ERBITUX treatment and those who do not (PD).

A two-sided unequal variance t test was performed between the 9 patients who derive clinical benefit and the 21 patients who have progressive disease. Three probesets out of 42 are differentially expressed between 9 (PR+SD) patients and 21 (PD) patients (p<0.05). These probesets represent the mRNA expression of Annexin A1 (ANXA1 201012_at), serine proteinase inhibitor Glade B member 5 (SERPINB5 204855_at), and fibroblast growth factor receptor 3 (FGFR3 204379_s_at).

Next, a broader list of 640 genes from which the 42 probe set list had been derived (FIG. 1) was examined. 635 out of the 640 probesets were present in the 17,261 probe sets that are included in the analysis. The 635 probesets were identified as being highly variably expressed in transcriptional profiles of 164 primary untreated CRC tumors. They expressed at a moderate to high level in colon tumors (at least one expression value of two times the mean value for the array, i.e., 3000 expression units) and with a population variance value of >0.1.

Figure 2:
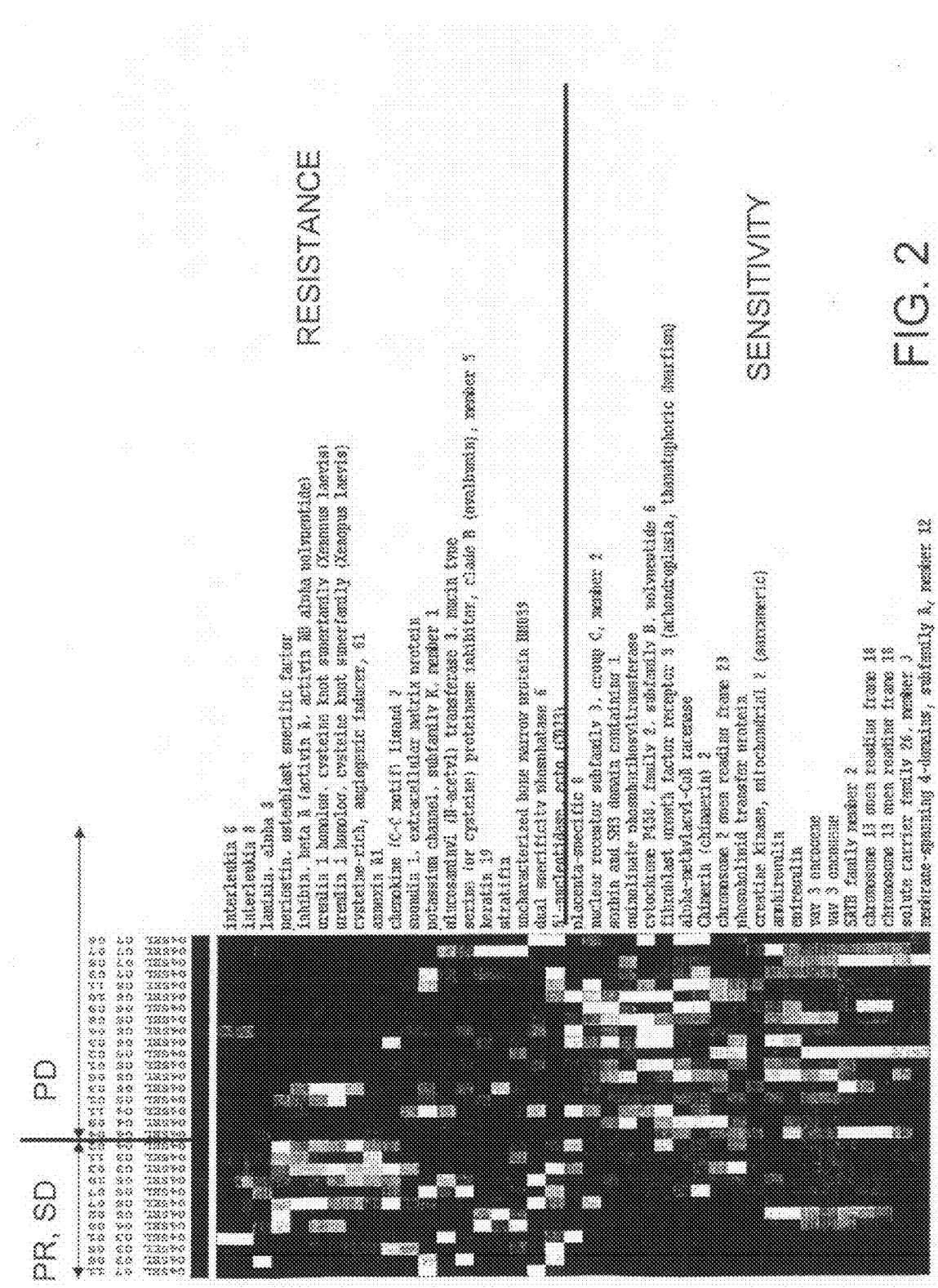
FIG. 2 illustrates the expression profiling of the biomarkers described herein.

The 635 probe sets were examined in transcriptional profiles of 30 metastatic tumors from the CA225-045 trial. 39 out of 635 probesets were found to be differentially expressed between 9 (PR+SD) and 21 (PD), p<0.05 and are described in Table 2. 19 of the 39 probe sets are resistance markers for ERBITUX and 20 of these are sensitivity markers for ERBITUX (FIG. 2).

TABLE 2

39 Markers for Response Prediction to ERBITUX

| | Affymetrix ID | p value | Gene name | Symbol |
|---|---|---|---|---|
| 1 | 205767_at | 0.0002 | epiregulin | EREG |
| 2 | 201012_at | 0.006 | annexin A1 | ANXA1 |
| 3 | 205239_at | 0.0068 | amphiregulin | AREG |
| 4 | 213435_at | 0.0098 | SATB family member 2 | SATB2 |
| 5 | 209260_at | 0.0122 | stratifin | SFN |
| 6 | 204379_s_at | 0.0129 | fibroblast growth factor receptor 3 | FGFR3 |
| 7 | 205295_at | 0.0143 | creatine kinase, mitochondrial 2 | CKMT2 |
| 8 | 204678_s_at | 0.0148 | potassium channel, subfamily K, memb. 1 | KCNK1 |
| 9 | 204044_at | 0.0151 | quinolinate phosphoribosyltransferase | QPRT |
| 10 | 203726_s_at | 0.0154 | laminin, alpha 3 | LAMA3 |
| 11 | 219555_s_at | 0.0165 | uncharacterized bone marrow prtn BM039 | BM039 |
| 12 | 216598_s_at | 0.0188 | chemokine (C-C motif) ligand 2 | CCL2 |
| 13 | 209425_at | 0.0195 | alpha-methylacyl-CoA racemase | AMACR |
| 14 | 204855_at | 0.0207 | serine proteinase inhibitor, clade B, memb. 5 | SERPINB5 |
| 15 | 218807_at | 0.0213 | vav 3 oncogene | VAV3 |
| 16 | 210764_s_at | 0.0261 | cysteine-rich, angiogenic inducer, 61 | CYR61 |
| 17 | 210511_s_at | 0.0265 | inhibin, beta A | INHBA |
| 18 | 220834_at | 0.0266 | membrane-spanning 4-domains, subfly A, 12 | MS4A12 |
| 19 | 210809_s_at | 0.0268 | periostin, osteoblast specific factor | POSTN |
| 20 | 213385_at | 0.0304 | chimerin 2 | CHN2 |

TABLE 2-continued

39 Markers for Response Prediction to ERBITUX

| | Affymetrix ID | p value | Gene name | Symbol |
|---|---|---|---|---|
| 21 | 218468_s_at | 0.0323 | gremlin 1 homolog, cysteine knot superfamily | GREM1 |
| 22 | 202859_x_at | 0.033 | interleukin 8 | IL8 |
| 23 | 206754_s_at | 0.0337 | cytochrome P450, 2B6 | CYP2B6 |
| 24 | 218806_s_at | 0.034 | vav 3 oncogene | VAV3 |
| 25 | 218469_at | 0.0342 | gremlin 1 homolog, cysteine knot superfamily | GREM1 |
| 26 | 219508_at | 0.0347 | glucosaminyl (N-acetyl) transferase 3, mucin type | GCNT3 |
| 27 | 204364_s_at | 0.0367 | chromosome 2 open reading frame 23 | C2orf23 |
| 28 | 219471_at | 0.0376 | chromosome 13 open reading frame 18 | C13orf18 |
| 29 | 219014_at | 0.0396 | placenta-specific 8 | PLAC8 |
| 30 | 203939_at | 0.04 | 5'-nucleotidase, ecto (CD73) | NT5E |
| 31 | 211506_s_at | 0.0401 | interleukin 8 | IL8 |
| 32 | 206143_at | 0.0404 | solute carrier family 26, member 3 | SLC26A3 |
| 33 | 44790_s_at | 0.0425 | chromosome 13 open reading frame 18 | C13orf18 |
| 34 | 202075_s_at | 0.0427 | phospholipid transfer protein | PLTP |
| 35 | 201650_at | 0.0436 | keratin 19 | KRT19 |
| 36 | 205259_at | 0.046 | nuclear receptor subfamily 3, C2 | NR3C2 |
| 37 | 208893_s_at | 0.0466 | dual specificity phosphatase 6 | DUSP6 |
| 38 | 209436_at | 0.048 | spondin 1, extracellular matrix protein | SPON1 |
| 39 | 218087_s_at | 0.0496 | sorbin and SH3 domain containing 1 | SORBS1 |

Figure 3A:
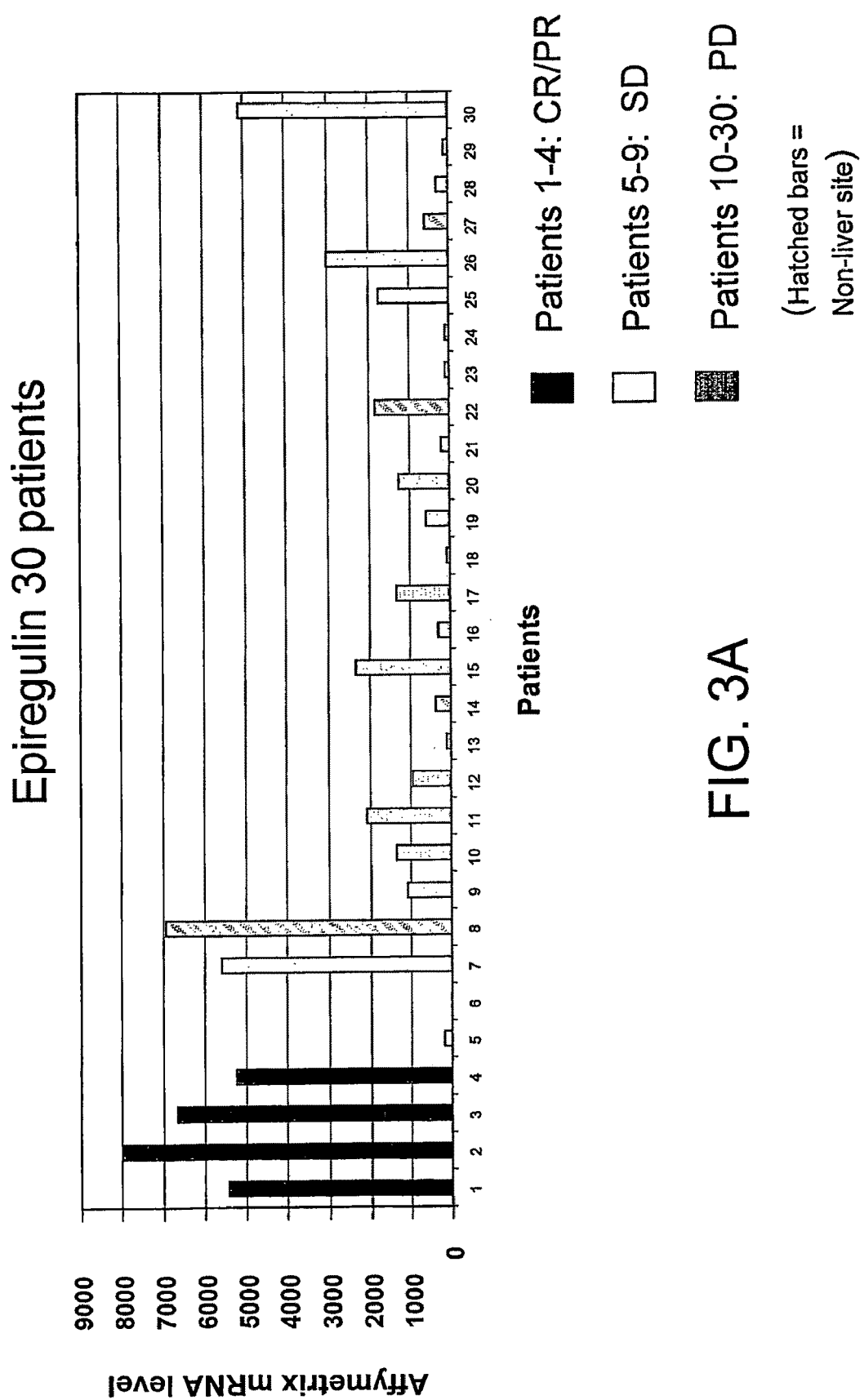
FIG. 3 (FIGS. 3A and 3B) illustrates the mRNA expression profiles of epiregulin and amphiregulin in 30 patients.
Figure 3B:
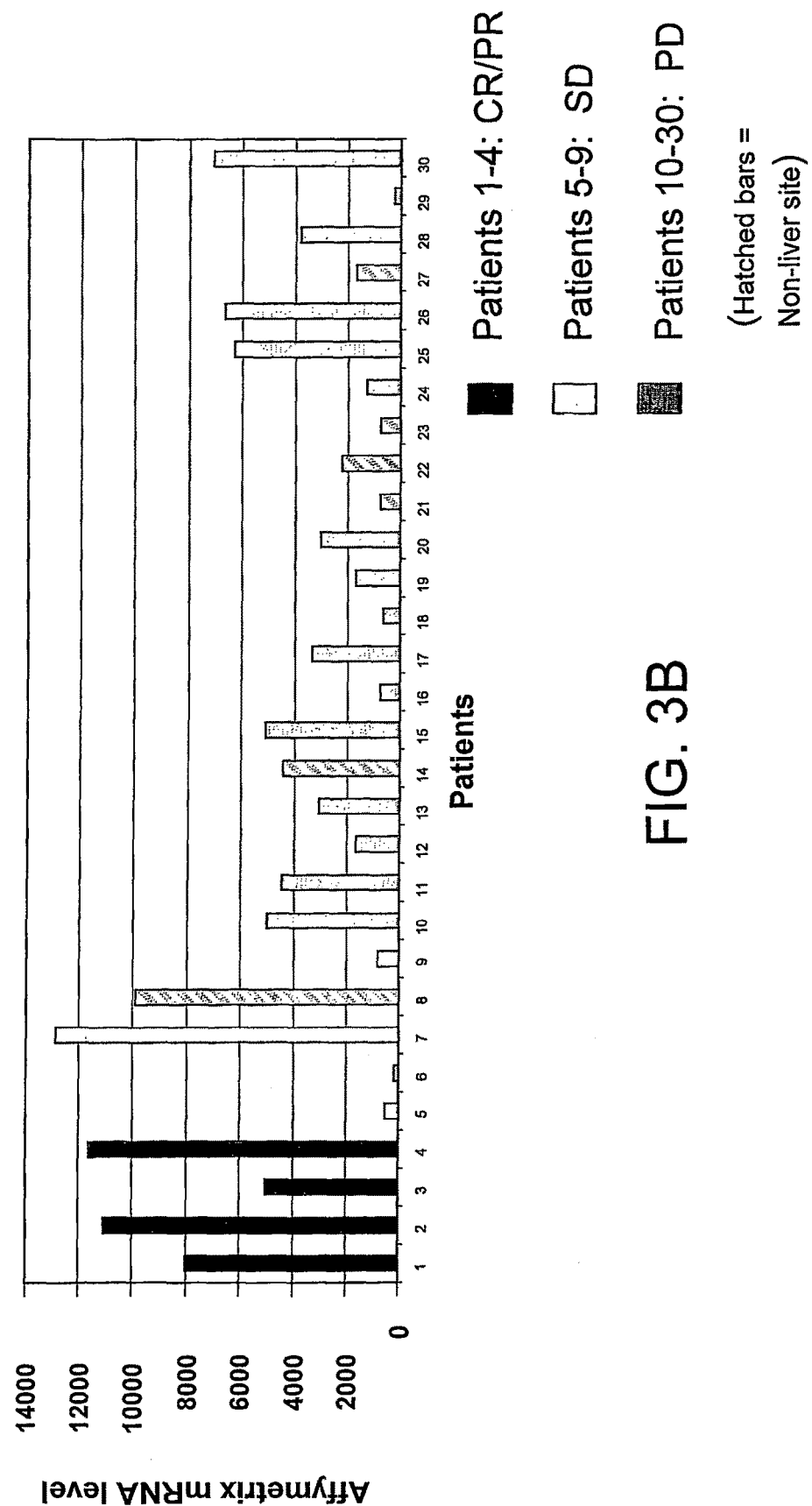

The top 3 markers based on lowest p value were epiregulin (EREG, 205767_at), annexin A1 (ANXA1 201012_at), and amphiregulin (AREG, 205239_at). Interestingly, epiregulin and amphiregulin are ligands for EGFR. Examination of their individual mRNA expression profiles indicates that they appear to be more highly expressed in patients who derive clinical benefit from ERBITUX treatment (FIGS. 3A and 3B). This suggests that patients who have high levels of epiregulin and amphiregulin have tumors that are addicted to the EGFR signaling pathway that is being driven by these two ligands.

The expression levels of epidermal growth factor (EGF, 206254_at), transforming growth factor alpha (TGFα, 205016_at), betacellulin (BTC, 207326_at), and heparin binding-EGF (HB-EGF, 203821_at), which are the other known ligands for EGFR, were also examined. Their expression levels showed no correlation with response to ERBITUX.

Figure 4:
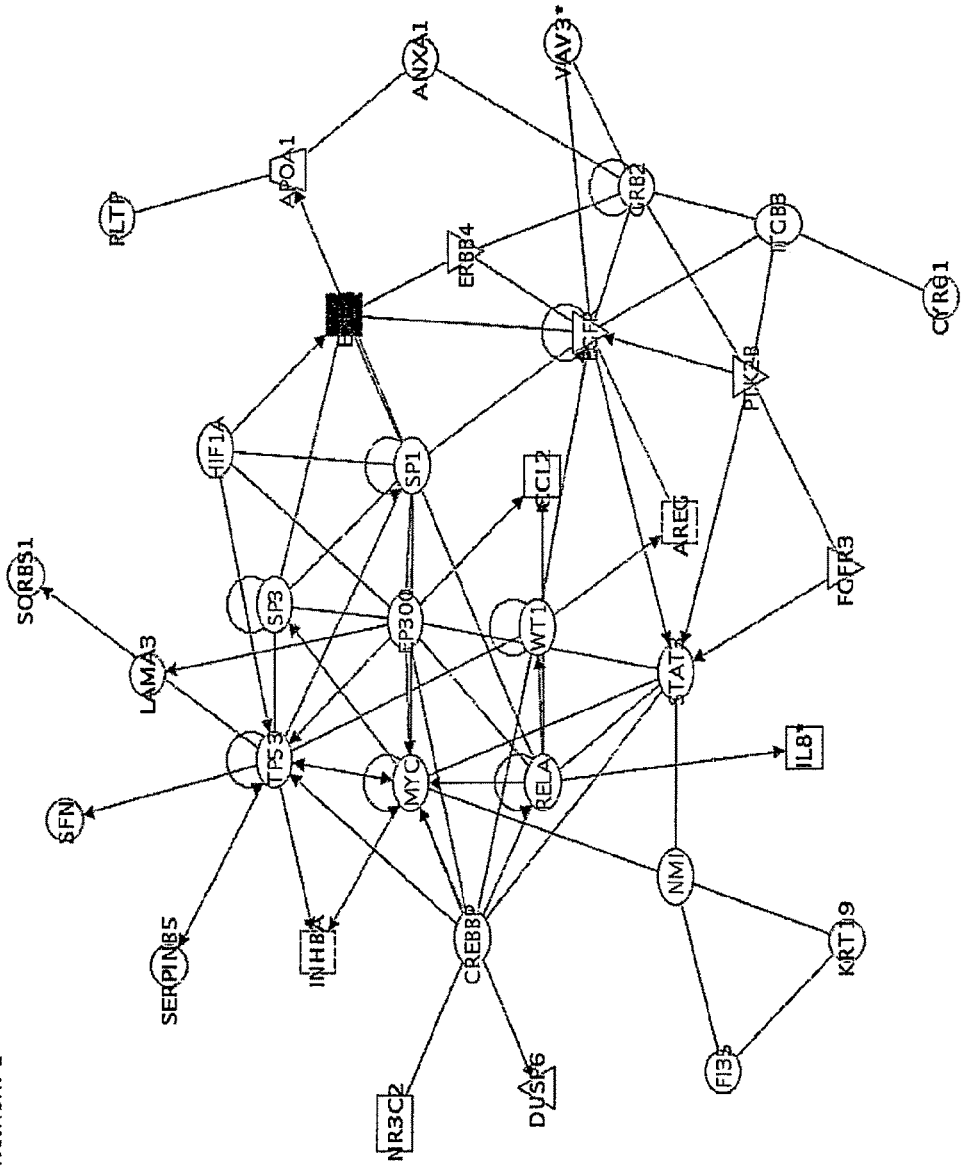
FIG. 4 illustrates the biological relationship of biomarkers described herein using Ingenuity Pathway Analysis.

Determination of Biological Relationships Between 39 Biomarkers:

The Ingenuity Pathway Analysis web-based application (Ingenuity Systems Inc., Mountain View, Calif.) was used to test the biological relationship between the 39 biomarkers of Table 2. This application makes use of the Ingenuity Knowledge Base, a curated database consisting of millions of individually modeled relationships between proteins, genes, complexes, cells, tissues, drugs, and diseases. The 39 genes were inputted into the Pathway Analysis application. The Ingenuity Knowledge base had information on 25 of the 39 genes. Strikingly, of the 25 "network eligible" genes, 17 mapped to the EGFR network (FIG. 4, 17 genes are shaded) indicating a strong link between the EGFR signaling status in the tumors and response to ERBITUX. No other network emerged from the analysis of the 39 genes. Of the 17 genes, DUSP6 is a member of the ERK/MAPK signaling pathway and SFN is a member of the PI3K/AKT signaling pathway, which are the two key pathways downstream of EGFR signaling.

Multivariate Analysis:

The t test and ANOVA analysis was used to assess the ability of individual biomarkers to separate PR/SD patients from PD patients. Multivariate discriminant analysis was used to assess the prediction power of the 39 markers on patient response, and identify the set of variables/biomarkers that would be the best predictors of response to ERBITUX treatment.

SAS discriminant function analysis (SAS Scientific Discovery Solutions, release 8.02, SAS Institute Inc., Cary, N.C.) was applied to the data set of 39 markers. Discriminant function analysis was broken into a 2-step process: (1) testing the significance of a set of discriminant functions; and (2) using these functions to classify the sample objects to the corresponding response groups. The first step was accomplished by a SAS "stepwise" procedure using the forward variable selection method. The derived discriminant functions were passed on to the second SAS procedure, called the "discrim" procedure, for classification of the given samples.

Figure 5:
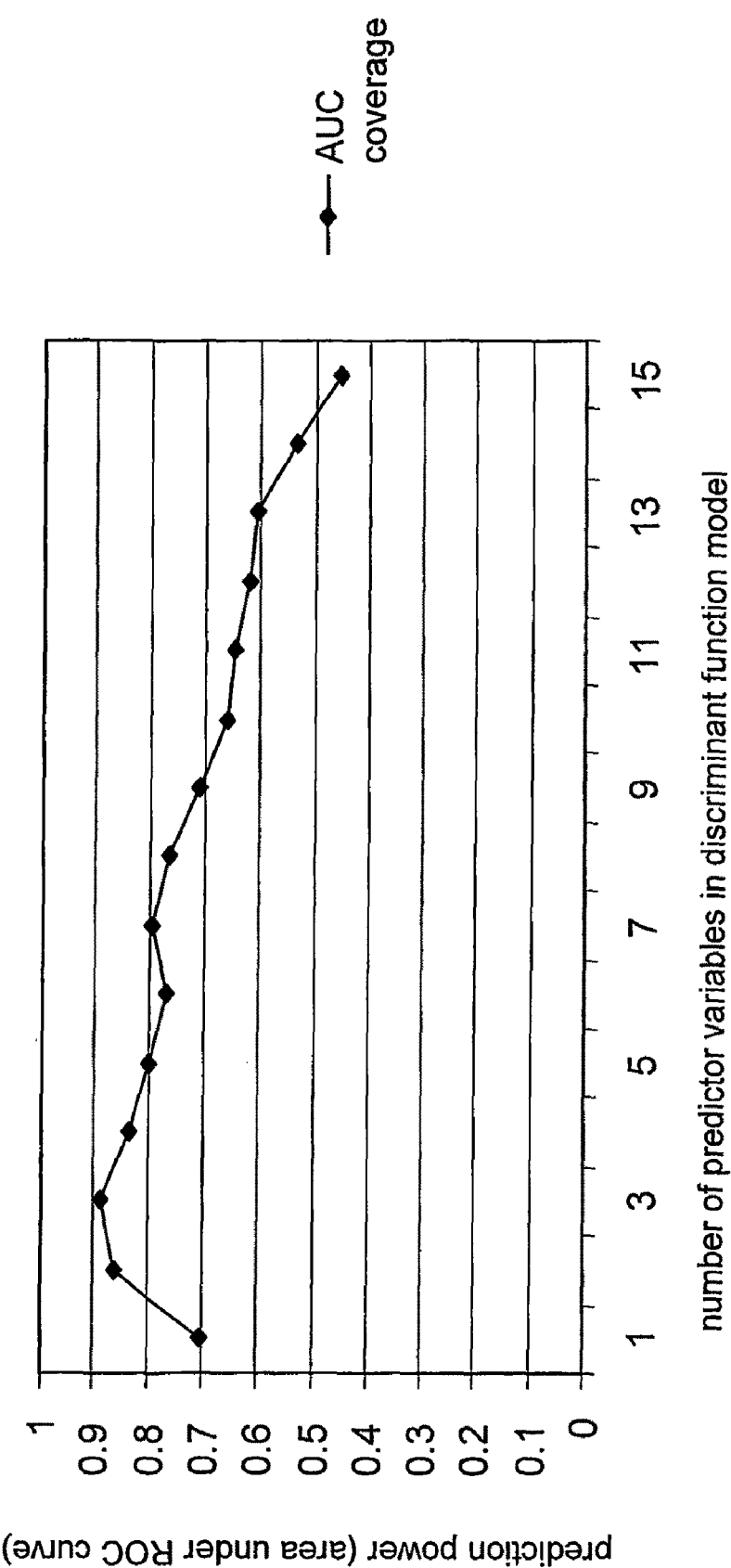
FIG. 5 illustrates a comparison of a single biomarker model to multiple biomarker models.

Given the small sample size of 30 patients, the samples were not partitioned into separate training and test data sets. Instead a single data set was used, and the leave-one-out cross-validation method was applied to test the prediction power of the identified biomarker predictors. A SAS cross-validation protocol was developed, which implemented leave-one-out cross-validation method in a SAS program, and was run on this data set to define the number of predictors that could be used for building the discriminant function models. This method allowed a comparison of a single biomarker model to multiple biomarker models (up to 15 biomarkers) (FIG. 5). The single gene predictor model was found to have 0.7037 prediction power as measured by AUC coverage (area under the Receiver Operating Characteristic (ROC) curve which shows the tradeoff between sensitivity and specificity). An area of 1 represents completely accurate prediction. When the number of predictors included in the model goes up to three biomarkers, the prediction power increases to 0.9. When the number of predictors included in the model exceeds three, there tends to be a decrease in prediction power. These results indicate that the best prediction power is achieved by building a discriminant function model with 3 out of the 39 biomarkers.

Correlation of the 39 Biomarkers:

Ingenuity Pathway analysis suggested that at least 17 of the 39 biomarkers identified belong to a single interaction network. A correlation analysis using SAS "corr" procedure was applied to investigate the correlation of genes identified from the discriminant analysis. Table 3 shows an example of a correlation matrix of some of the top predictors selected by the SAS procedure. Some of the genes show very high correlation coefficient values which suggests they are highly correlated. For example, 205767_at (EREG) and 205239_at (AREG), or 205767_at (EREG) and 218807_at (VAV3), or 206754_s_at (CYP2B6) and 209260_at (SFN) were found to be highly correlated. The highly correlated genes could replace each other to explain a certain proportion of the variation between the groups of patients who derive clinical benefit and those that do not. These results show excellent agreement between the possible biological mechanism as elucidated by Ingenuity Pathway Analysis and literature, and the statistical prediction as determined by the SAS procedure.

TABLE 3

Pearson Correlation Co-Efficients on 7 Most Frequent Probesets That Were Identified As Top Variables For Discriminant Analysis

| Affymetrix ID | 205767_at | 201012_at | 205239_at | 206754_at | 209260_at | 205259_at | 218807_at |
|---|---|---|---|---|---|---|---|
| 205767_at | 1 | −0.28587 | 0.84089 | −0.16409 | −0.04261 | −0.02338 | 0.64133 |
| 201012_at | −0.28587 | 1 | −0.16652 | −0.41722 | 0.31615 | −0.45851 | 0.28141 |
| 205239_at | 0.84089 | −0.16652 | 1 | −0.21894 | 0.07064 | −0.19815 | 0.60752 |
| 206754_s_at | −0.16409 | −0.41722 | −0.21894 | 1 | −0.47769 | 0.53511 | −0.21663 |
| 209260_at | −0.04261 | 0.31615 | 0.07064 | −0.47769 | 1 | −0.26621 | 0.26204 |
| 205259_at | −0.02338 | −0.45851 | −0.19815 | 0.53511 | −0.26621 | 1 | −0.02668 |
| 218807_at | 0.64133 | −0.28141 | 0.60752 | −0.21663 | 0.26204 | −0.02668 | 1 |

Best Prediction Models:

The best prediction models were determined using the SAS stepwise procedure. 205767_at (EREG) was always picked first. This suggests that the expression of the EGFR ligand epiregulin can explain most of the variation that exists between the group of patients that are PR/SD and the group of patients who are PD. The second predictor aids in picking up the largest proportion of the unexplained variation from the first variable function (predictor) and so on. The misclassification rates of the best SAS selected models were:

| Model | Error rate |
|---|---|
| 205767_at (EREG) | 0.2143 |
| 205767_at (EREG), 206754_s_at (CYP2B6) | 0.127 |
| 205767_at (EREG), 206754_s_at (CYP2B6), 201650_at (KRT19) | 0.1032 |
| 205767_at (EREG), 206754_s_at (CYP2B6), 201650_at (KRT19), 204678_at (KCNK1) | 0.1032 |

Biomarkers were also selected based on their biological, functional, and co-regulation information, and the derived prediction functions were used to classify the 30 sample data set using the SAS "discrim" procedure. Using this approach, some optimal combinations of biomarker variables and their corresponding misclassification rates were identified, such as:

| Model | Error rate |
|---|---|
| 205767_at (EREG), 206754_s_at (CYP2B6) 201650_at (KRT19) | 0.1032 |
| 205767_at (EREG), 209260_at (SFN), 205259_at (NR3C2) | 0.079 |
| 201012_at (ANXA1), 205239_at (AREG), 209260_at (SFN), 205259_at (NR3C2), 218807_at (VAV3) | 0.07 |
| 209260_at (SFN), 218807_at (VAV3) | 0.1270 |

Example 2

Identification of Biomarkers Following Interim Analysis

As mentioned above, the CA225-045 pharmacogenomics trial is a phase II randomized exploratory study of ERBITUX (cetuximab) monotherapy in patients with refractory metastatic colorectal cancer (mCRC). This trial enrolled 111 patients. A standard cetuximab dosing regimen was followed for the first 3 weeks of therapy, thereafter patients were eligible for dose escalation every 3 weeks to a maximum dose of 400 mg/m$^2$ provided they had not experienced a >grade 2 skin rash. During the pre-treatment phase, all patients underwent a tumor biopsy procedure involving three passes with an 18-gauge needle of a single metastatic lesion. Two pre-treatment core needle biopsies were stored in a single tube of RNALater at room temperature and one core needle biopsy was formalin-fixed and embedded in paraffin for subsequent analyses. All subjects also underwent a pre-treatment blood draw. All specimens were obtained from patients with appropriate informed consent and IRB approval.

Tumor response was evaluated every nine weeks (one cycle of therapy) according to the modified World Health Organization criteria (Miller et al., Cancer, 47, 207-214 (1981)). Overall response was determined based on evaluation of target, non-target and new lesions. For this analysis, subjects experiencing a complete (CR) or partial response (PR), or stable disease (SD), were grouped as the disease control group; progressive disease (PD) and select unable to determine (UTD) subjects were grouped as non-responders. The UTD subjects that were included in the non-responder group for analysis were those that died prior to the response assessment. All other UTD subjects were excluded from the analysis.

RNA and DNA Extraction:

For each subject's tumor sample, RNA and DNA were isolated from two pre-treatment core needle biopsies provided in a single tube of RNALater at room temperature within seven days from the date of the biopsy procedure. RNA was isolated using the RNeasy mini kit (Qiagen, Valencia, Calif.). The quality of RNA was checked by measuring the 28S:18S ribosomal RNA ratio using an Agilent 2100 Bioanalyzer (Agilent Technologies, Rockville, Md.). DNA was isolated from the flow-through collected during the RNA isolation procedure using the DNeasy mini kit (Qiagen). Concentration of RNA and DNA was determined spectrophotometrically.

Gene Expression Profiling and Statistical Analysis:

For each sample from which sufficient RNA was available, 1 µg of total RNA was used to prepare biotinylated probes according to the Affymetrix GeneChip Expression Analysis Technical Manual. Targets were hybridized to human HG-U133A v2.0 GeneChips according to the manufacturer's instructions. Data were preprocessed using the MAS 5.0 software (Affymetrix, Santa Clara, Calif.) and statistical analyses were performed using quantile normalized values for signal intensity. Univariate analysis was done by using a two-sided unequal variance t-test. For multivariate analysis samples were randomly partitioned 50-50 into a training set and a test set. Top candidate predictors were selected from the training set using a t-test. This was followed by model construction using stepwise discriminant analysis (v8.2, SAS, Cary, N.C.). Class prediction was assessed using 10-fold cross validation. The models developed from the training set were evaluated using a test set.

In addition to the profiling of RNA from the clinical study, an expression database of 164 primary colorectal tumors (Banerjea et al., Mol. Cancer, 3, 21 (2004)) was examined to identify potential predictive markers. Data from the 640 probe sets that passed the filtering steps described above in the results were then subjected to an unsupervised average linkage hierarchical clustering using CLUSTER and the results were displayed by using TREEVIEW.

RT-qPCR for Gene Expression Analysis:

For each sample from which RNA was available, approximately 100 ng RNA was converted into cDNA by the random priming method using MultiScribe Reverse Transcriptase according to the manufacturer's instructions (TaqMan Reverse Transcription Reagents, Applied Biosystems Inc. ((ABI), Foster City, Calif.). The resulting cDNA was measured on the ABI 7900HT Sequence Detection System using ABI Assay-on-Demand primer/probe sets directed against the amphiregulin (Hs00155832_m1) and epiregulin (Hs00154995_m1) genes. Relative expression levels were calculated using the ΔCt method in which average values of duplicate reactions were compared, with GAPDH (Hs001266705_g1) serving as the internal reference. In this experimental design, low ΔCt values correspond to high levels of expression.

Nucleotide Sequence Analysis:

Mutational analyses of EGFR, K-RAS, and BRAF were performed using available genomic DNAs isolated from tumor specimens. Primers used for EGFR exons 18-21, coding for the TK domain, were published previously (Lynch et al., N. Engl. J. Med., 350, 2129-2139 (2004)). The primers used to evaluate exon 2 of K-RAS and exon 15 of BRAF were as follows: K-RAS F 5'-TAAGGCCTGCTGAAAAT-GACTG-3' (SEQ ID NO:257) and K-RAS R 5'-TGGTCCT-GCACCAGTAA TATGC-3' (SEQ ID NO:258); BRAF F 5'-TCATAATGCTTGCTCTGATAGGA-3' (SEQ ID NO:259) and BRAF R 5'-GGCCAAAAATTTAAT-CAGTGGA-3' (SEQ ID NO:260). PCR was performed using conditions as previously described (Chen et al., Hum. Mutat., 27, 427-435 (2006)). PCR fragments were cleaned with QIAquick PCR Purification Kit (Qiagen), sequenced on an ABI 3100A Capillary Genetic Analyzer (Applied Biosystems Inc.) and analyzed in both sense and antisense directions for the presence of heterozygous mutations. Analysis of the DNA sequence was performed using SEQUENCHER v4.2 (Gene Codes, Ann Arbor, Mich.) followed by visual analysis of each electropherogram by two independent reviewers. Appropriate positive and negative controls were included for each of the exons evaluated. Mutational analyses were done without knowledge of clinical outcome including tumor response.

Results

Patients' Characteristics and Clinical Outcome:

The primary objective of this study was to identify predictive markers of response to cetuximab therapy in CRC. Evaluable RNA and/or DNA and/or plasma samples were available for 103 out of 111 subjects. The objective response determination for these 103 subjects were: one complete response (CR), six partial response (PR), twenty-eight stable disease (SD), fifty-six progressive disease (PD), and twelve patients who died prior to their first radiographic assessment and are therefore unable to determine (UTD). Thirty-four percent of the subjects either responded or had disease stabilization whereas the remaining 66% were classified as non-responders.

Genomic Analysis of Tumor-Derived RNAs:

In order to identify genes that were differentially expressed between the disease control and non-responder groups, gene expression profiling was carried out on RNA isolated from 95 pre-treatment biopsies. Seventy percent of the biopsies were taken from the liver metastatic tissue, and 30% of the biopsies were taken from non-hepatic tissue sites. 91 out of the 95 samples yielded >500 ng RNA and were randomized into ten blocks and profiled on U133A v2.0 chips (Affymetrix). High quality transcriptional profiling data were obtained from 87 patients. Seven patients were excluded from further analysis either because they withdrew from the study prior to the first assessment, experienced hypersensitivity or withdrew their consent. Final data analysis was carried out using best clinical response assessments for the remaining 80 patients and expression profiles from these patients were included in the statistical analysis. These 80 patients included 1 CR, 5 PR, 19 SD, 43 PD, and 12 UTD.

An initial candidate set of genes was identified that were variably expressed in an independent set of 164 primary colorectal tumors by filtering transcriptional data from all 22,215 probe sets. This filtering yielded 640 probe sets that were expressed at a moderate to high level in colon tumors (at least one expression value of two times the mean value for the array i.e. 3000 expression units) and with a population variance value of >0.1. It was proposed that these 640 probe sets that had a highly dynamic range of expression across a population of CRC tumors were most likely to yield markers that would be useful for patient selection. Unsupervised hierarchical clustering of the 640 probe sets across the 164 primary colon tumors showed that biologically interesting genes that might be predictive of response to cetuximab were preferentially expressed in a subset of colorectal tumors (FIG. 6). In FIG. 6, the 164 tumors were divided into 3 major classes (Class 1, 2 and 3). The 640 probe sets were divided into 5 clusters (labeled A through E). Cluster A, which contains cancer antigens such as CEACAM 6 and CD24, also contains the EGFR ligands EREG and AREG. Cluster A is most highly expressed iii Class 1a, which represents approximately 25% of the 164 colorectal tumor specimens.

Out of 22,215 probe sets, data analysis was conducted on 17,137 probe sets that were found to be expressed in at least 10% of the liver metastases patient samples. 629 of the previously identified 640 probe sets were present in the 17,137 probe set list. Their gene expression profiles were examined in the data from 80 patients and were correlated with response assessments. 121 out of the 629 probe sets were found to be differentially expressed between 25 patients with disease control and 55 non-responders, $p<0.05$ (t test of the disease group (CR, PR, SD) vs. non-responders) as shown in Table 4.

TABLE 4

121 Probe Sets Differentially Expressed Between 25 patients with disease control and 55 non-responders, $p < 0.05$

| Affymetrix ID | p value | Gene name | Symbol |
|---|---|---|---|
| 203939_at | 3.787E-07 | 5'-nucleotidase, ecto (CD73) | NT5E |
| 205767_at | 1.474E-05 | epiregulin | EREG |
| 205239_at | 2.489E-05 | amphiregulin (schwannoma-derived growth factor) | AREG |
| 213975_s_at | 3.617E-05 | lysozyme (renal amyloidosis) /// leukocyte immunoglobulin-like receptor, subfamily B (with TM and ITIM domains), member 1 | LYZ /// LILRB1 |
| 201641_at | 9.146E-05 | bone marrow stromal cell antigen 2 | BST2 |
| 208893_s_at | 0.000257 | dual specificity phosphatase 6 | DUSP6 |
| 218807_at | 0.000507 | vav 3 oncogene | VAV3 |
| 218806_s_at | 0.000513 | vav 3 oncogene | VAV3 |
| 216598_s_at | 0.000680 | chemokine (C-C motif) ligand 2 | CCL2 |
| 213435_at | 0.000909 | SATB family member 2 | SATB2 |
| 210517_s_at | 0.001636 | A kinase (PRKA) anchor protein (gravin) 12 | AKAP12 |
| 219508_at | 0.001935 | glucosaminyl (N-acetyl) transferase 3, mucin type | GCNT3 |
| 201462_at | 0.001937 | secernin 1 | SCRN1 |
| 204379_s_at | 0.002008 | fibroblast growth factor receptor 3 (achondroplasia, thanatophoric dwarfism) | FGFR3 |
| 206584_at | 0.002018 | lymphocyte antigen 96 | LY96 |
| 200884_at | 0.002042 | creatine kinase, brain | CKB |
| 206332_s_at | 0.002612 | interferon, gamma-inducible protein 16 | IFI16 |
| 202525_at | 0.002630 | protease, serine, 8 (prostasin) | PRSS8 |
| 205403_at | 0.002869 | interleukin 1 receptor, type II | IL1R2 |
| 221530_s_at | 0.002881 | basic helix-loop-helix domain containing, class B, 3 | BHLHB3 |
| 209728_at | 0.003260 | major histocompatibility complex, class II, DR beta 4 /// major histocompatibility complex, class II, DR beta 4 | HLA-DRB4 |
| 215049_x_at | 0.004039 | CD163 antigen | CD163 |
| 203645_s_at | 0.004182 | CD163 antigen | CD163 |
| 219471_at | 0.004627 | chromosome 13 open reading frame 18 | C13orf18 |
| 210133_at | 0.004790 | chemokine (C-C motif) ligand 11 | CCL11 |
| 205097_at | 0.005553 | solute carrier family 26 (sulfate transporter), member 2 | SLC26A2 |
| 211656_x_at | 0.006050 | major histocompatibility complex, class II, DQ beta 1 /// major histocompatibility complex, class II, DQ beta 1 | HLA-DQB1 |
| 209392_at | 0.006150 | ectonucleotide pyrophosphatase/phosphodiesterase 2 (autotaxin) | ENPP2 |
| 205402_x_at | 0.006181 | protease, serine, 2 (trypsin 2) | PRSS2 |
| 217028_at | 0.006582 | chemokine (C—X—C motif) receptor 4 | CXCR4 |
| 204855_at | 0.006615 | serpin peptidase inhibitor, clade B (ovalbumin), member 5 | SERPINB5 |
| 201137_s_at | 0.007369 | major histocompatibility complex, class II, DP beta 1 | HLA-DPB1 |
| 215051_x_at | 0.007563 | allograft inflammatory factor 1 | AIF1 |
| 202859_x_at | 0.007872 | interleukin 8 | IL8 |
| 211506_s_at | 0.008119 | interleukin 8 | IL8 |
| 207457_s_at | 0.008600 | lymphocyte antigen 6 complex, locus G6D | LY6G6D |
| 205765_at | 0.009101 | cytochrome P450, family 3, subfamily A, polypeptide 5 | CYP3A5 |
| 204619_s_at | 0.009733 | chondroitin sulfate proteoglycan 2 (versican) | CSPG2 |
| 205199_at | 0.010621 | carbonic anhydrase IX | CA9 |
| 219962_at | 0.010751 | angiotensin I converting enzyme (peptidyl-dipeptidase A) 2 | ACE2 |
| 205242_at | 0.011022 | chemokine (C—X—C motif) ligand 13 (B-cell chemoattractant) | CXCL13 |

TABLE 4-continued

121 Probe Sets Differentially Expressed Between 25 patients
with disease control and 55 non-responders, p < 0.05

| Affymetrix ID | p value | Gene name | Symbol |
|---|---|---|---|
| 217428_s_at | 0.011274 | collagen, type X, alpha 1(Schmid metaphyseal chondrodysplasia) | COL10A1 |
| 206918_s_at | 0.011540 | copine I | CPNE1 |
| 44790_s_at | 0.011645 | chromosome 13 open reading frame 18 | C13orf18 |
| 218469_at | 0.011704 | gremlin 1, cysteine knot superfamily, homolog (*Xenopus laevis*) | GREM1 |
| 209823_x_at | 0.011862 | major histocompatibility complex, class II, DQ beta 1 | HLA-DQB1 |
| 205513_at | 0.011867 | transcobalamin I (vitamin B12 binding protein, R binder family) | TCN1 |
| 204213_at | 0.012198 | polymeric immunoglobulin receptor | PIGR |
| 205941_s_at | 0.012335 | collagen, type X, alpha 1(Schmid metaphyseal chondrodysplasia) | COL10A1 |
| 212192_at | 0.012522 | potassium channel tetramerisation domain containing 12 | KCTD12 |
| 204891_s_at | 0.012755 | lymphocyte-specific protein tyrosine kinase | LCK |
| 208029_s_at | 0.012800 | lysosomal associated protein transmembrane 4 beta /// lysosomal associated protein transmembrane 4 beta | LAPTM4B |
| 201884_at | 0.013032 | carcinoembryonic antigen-related cell adhesion molecule 5 | CEACAM5 |
| 201030_x_at | 0.013074 | lactate dehydrogenase B | LDHB |
| 202411_at | 0.013302 | interferon, alpha-inducible protein 27 | IFI27 |
| 211165_x_at | 0.013671 | EPH receptor B2 | EPHB2 |
| 212186_at | 0.014902 | acetyl-Coenzyme A carboxylase alpha | ACACA |
| 201743_at | 0.015156 | CD14 antigen /// CD14 antigen | CD14 |
| 87100_at | 0.015861 | — | — |
| 206467_x_at | 0.015975 | tumor necrosis factor receptor superfamily, member 6b, decoy /// regulator of telomere elongation helicase 1 | TNFRSF6B /// RTEL1 |
| 218468_s_at | 0.016329 | gremlin 1, cysteine knot superfamily, homolog (*Xenopus laevis*) | GREM1 |
| 222257_s_at | 0.016397 | angiotensin I converting enzyme (peptidyl-dipeptidase A) 2 | ACE2 |
| 221730_at | 0.016992 | collagen, type V, alpha 2 | COL5A2 |
| 203915_at | 0.017412 | chemokine (C—X—C motif) ligand 9 | CXCL9 |
| 206858_s_at | 0.017492 | homeo box C6 | HOXC6 |
| 221584_s_at | 0.017554 | potassium large conductance calcium-activated channel, subfamily M, alpha member 1 | KCNMA1 |
| 204475_at | 0.018085 | matrix metallopeptidase 1 (interstitial collagenase) | MMP1 |
| 203895_at | 0.018353 | phospholipase C, beta 4 | PLCB4 |
| 214043_at | 0.018926 | Protein tyrosine phosphatase, receptor type, D | PTPRD |
| 204678_s_at | 0.019645 | potassium channel, subfamily K, member 1 | KCNK1 |
| 204446_s_at | 0.019912 | arachidonate 5-lipoxygenase | ALOX5 |
| 204533_at | 0.020226 | chemokine (C—X—C motif) ligand 10 | CXCL10 |
| 211689_s_at | 0.020262 | transmembrane protease, serine 2 /// transmembrane protease, serine 2 | TMPRSS2 |
| 201858_s_at | 0.020471 | proteoglycan 1, secretory granule | PRG1 |
| 212671_s_at | 0.020852 | major histocompatibility complex, class II, DQ alpha 1 /// major histocompatibility complex, class II, DQ alpha 2 | HLA-DQA1 /// HLA-DQA2 |
| 216248_s_at | 0.021062 | nuclear receptor subfamily 4, group A, member 2 | NR4A2 |
| 212188_at | 0.021225 | potassium channel tetramerisation domain containing 12 /// potassium channel tetramerisation domain containing 12 | KCTD12 |
| 204070_at | 0.021833 | retinoic acid receptor responder (tazarotene induced) 3 | RARRES3 |

TABLE 4-continued

121 Probe Sets Differentially Expressed Between 25 patients with disease control and 55 non-responders, p < 0.05

| Affymetrix ID | p value | Gene name | Symbol |
|---|---|---|---|
| 213564_x_at | 0.022061 | lactate dehydrogenase B | LDHB |
| 209732_at | 0.022699 | C-type lectin domain family 2, member B | CLEC2B |
| 213746_s_at | 0.023141 | filamin A, alpha (actin binding protein 280) | FLNA |
| 214974_x_at | 0.023351 | chemokine (C—X—C motif) ligand 5 | CXCL5 |
| 201792_at | 0.023592 | AE binding protein 1 | AEBP1 |
| 213905_x_at | 0.023638 | biglycan /// serologically defined colon cancer antigen 33 | BGN /// SDCCAG33 |
| 212353_at | 0.024175 | sulfatase 1 | SULF1 |
| 209156_s_at | 0.024926 | collagen, type VI, alpha 2 | COL6A2 |
| 203083_at | 0.025140 | thrombospondin 2 | THBS2 |
| 203896_s_at | 0.025311 | phospholipase C, beta 4 | PLCB4 |
| 201617_x_at | 0.025316 | caldesmon 1 | CALD1 |
| 217963_s_at | 0.025667 | nerve growth factor receptor (TNFRSF16) associated protein 1 | NGFRAP1 |
| 208965_s_at | 0.025706 | interferon, gamma-inducible protein 16 | IFI16 |
| 217763_s_at | 0.026315 | RAB31, member RAS oncogene family | RAB31 |
| 203325_s_at | 0.026698 | collagen, type V, alpha 1 | COL5A1 |
| 209792_s_at | 0.026893 | kallikrein 10 | KLK10 |
| 205549_at | 0.027028 | Purkinje cell protein 4 | PCP4 |
| 204622_x_at | 0.028026 | nuclear receptor subfamily 4, group A, member 2 | NR4A2 |
| 210095_s_at | 0.030712 | insulin-like growth factor binding protein 3 | IGFBP3 |
| 209969_s_at | 0.031010 | signal transducer and activator of transcription 1, 91 kDa | STAT1 |
| 202436_s_at | 0.031792 | cytochrome P450, family 1, subfamily B, polypeptide 1 | CYP1B1 |
| 202311_s_at | 0.032306 | collagen, type I, alpha 1 | COL1A1 |
| 221031_s_at | 0.032415 | hypothetical protein DKFZp434F0318 /// hypothetical protein DKFZp434F0318 | DKFZP434F0318 |
| 209118_s_at | 0.032949 | tubulin, alpha 3 | TUBA3 |
| 210164_at | 0.033266 | granzyme B (granzyme 2, cytotoxic T-lymphocyte-associated serine esterase 1) /// granzyme B (granzyme 2, cytotoxic T-lymphocyte-associated serine esterase 1) | GZMB |
| 213194_at | 0.034686 | roundabout, axon guidance receptor, homolog 1 (Drosophila) | ROBO1 |
| 204697_s_at | 0.034934 | chromogranin A (parathyroid secretory protein 1) | CHGA |
| 202752_x_at | 0.035921 | solute carrier family 7 (cationic amino acid transporter, y+ system), member 8 | SLC7A8 |
| 205929_at | 0.037216 | glycoprotein A33 (transmembrane) | GPA33 |
| 204044_at | 0.037293 | quinolinate phosphoribosyltransferase (nicotinate-nucleotide pyrophosphorylase (carboxylating)) | QPRT |
| 205311_at | 0.037673 | dopa decarboxylase (aromatic L-amino acid decarboxylase) | DDC |
| 204320_at | 0.038710 | collagen, type XI, alpha 1 | COL11A1 |
| 204364_s_at | 0.040104 | chromosome 2 open reading frame 23 | C2orf23 |
| 212354_at | 0.040347 | sulfatase 1 | SULF1 |
| 202465_at | 0.040639 | procollagen C-endopeptidase enhancer | PCOLCE |
| 212992_at | 0.041178 | chromosome 14 open reading frame 78 | C14orf78 |
| 209201_x_at | 0.042126 | chemokine (C—X—C motif) receptor 4 | CXCR4 |
| 215646_s_at | 0.043050 | chondroitin sulfate proteoglycan 2 (versican) /// chondroitin sulfate proteoglycan 2 (versican) | CSPG2 |
| 202283_at | 0.045795 | serpin peptidase inhibitor, clade F (alpha-2 antiplasmin, pigment epithelium derived factor), member 1 | SERPINF1 |
| 209436_at | 0.046099 | spondin 1, extracellular matrix protein | SPON1 |

TABLE 4-continued

121 Probe Sets Differentially Expressed Between 25 patients with disease control and 55 non-responders, p < 0.05

| Affymetrix ID | p value | Gene name | Symbol |
|---|---|---|---|
| 37892_at | 0.048675 | collagen, type XI, alpha 1 | COL11A1 |
| 218559_s_at | 0.048679 | v-maf musculoaponeurotic fibrosarcoma oncogene homolog B (avian) | MAFB |
| 213998_s_at | 0.049742 | DEAD (Asp-Glu-Ala-Asp) box polypeptide 17 | DDX17 |

Figure 7A:
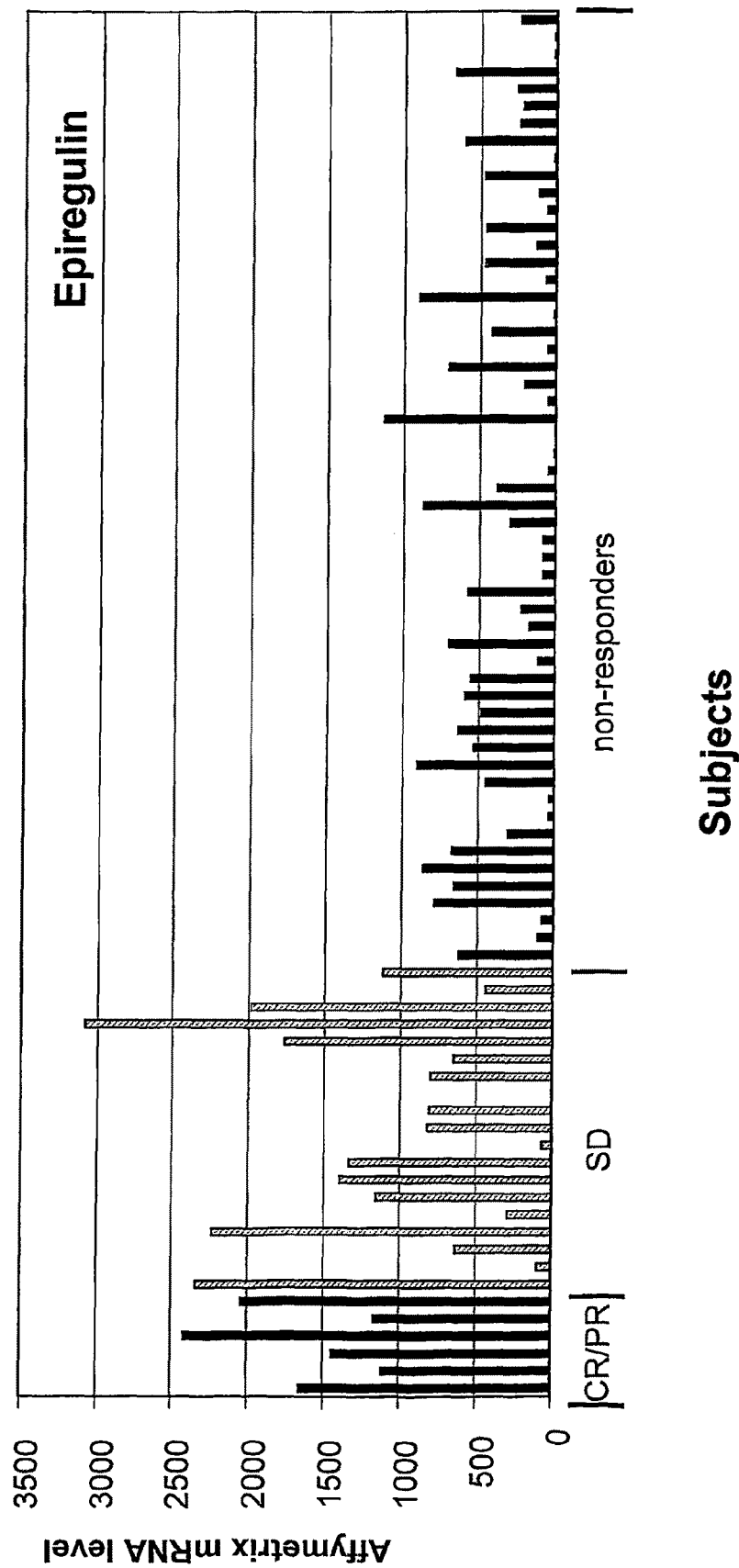
FIG. 7 (FIGS. 7A and 7B) illustrates the mRNA levels of epiregulin and amphiregulin in 80 patients. Affymetrix mRNA levels of epiregulin (EREG, 205767_at) and amphiregulin (AREG, 205239_at) are plotted on the y axis. Subjects are ordered by best clinical response. There is a statistically significant difference in gene expression levels between the disease control group (CR, PR and SD) and the non-responder group (EREG $p=1.474e^{-05}$, AREG $p=2.489e^{-05}$).
Figure 7B:
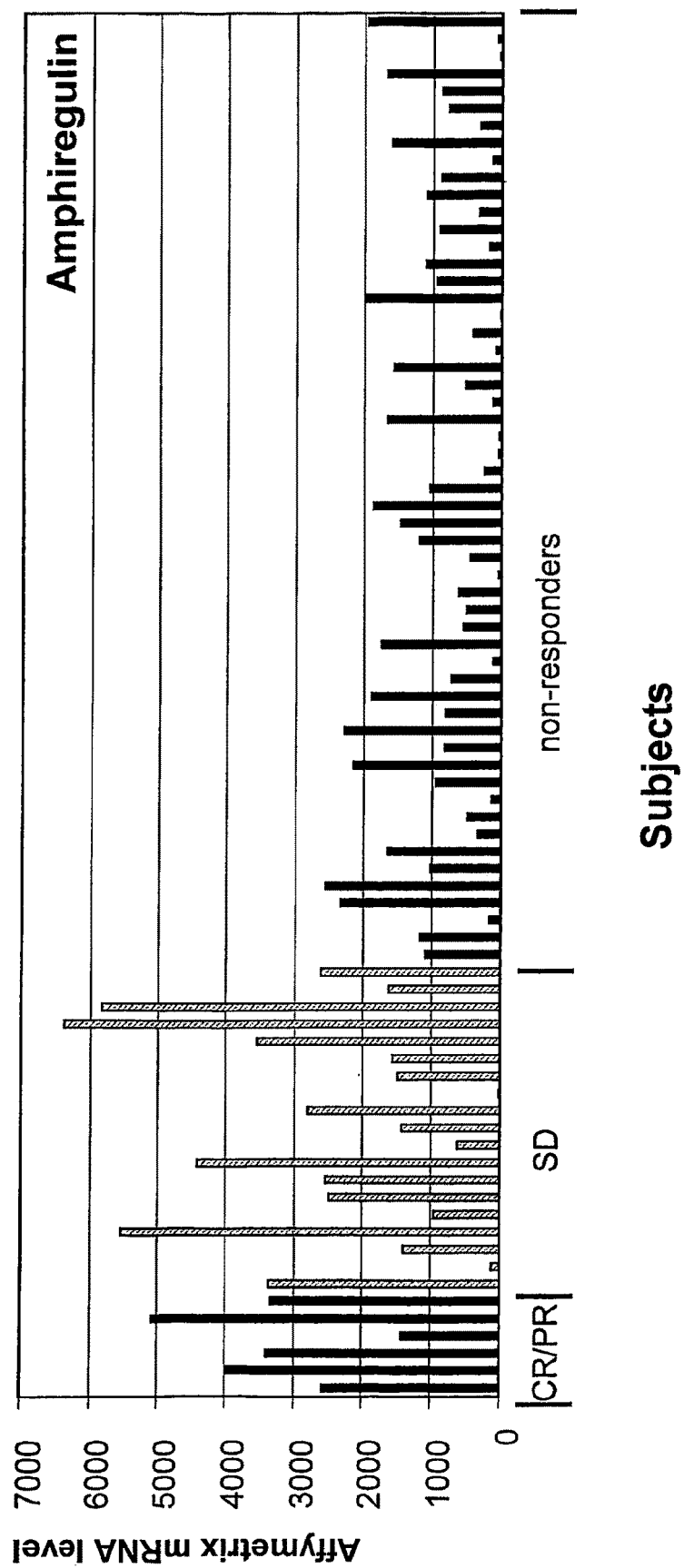

The top three candidate markers based on lowest p value were 5' nucleotidase ecto (CD73, 203939_at), epiregulin (EREG, 205767_at) and amphiregulin (AREG, 205239_at). CD73 is a purine metabolizing enzyme that may have prognostic value in colorectal and pancreatic cancer (Eroglu et al., Med. Oncol., 17, 319-324 (2000); Giovannetti et al., Cancer Res., 66, 3928-3935 (2006)). Examination of its mRNA profile showed that it is expressed at higher levels in the non-responder group. Epiregulin and amphiregulin are ligands for EGFR (Singh and Harris, Cell Signal, 17, 1183-1193 (2005)). Examination of their individual mRNA expression profiles revealed that they were more highly expressed in patients in the disease control group (FIGS. 7A and 7B). FIGS. 7A and 7B provide mRNA levels of EGFR ligands epiregulin and amphiregulin. Affymetrix mRNA levels of Epiregulin (EREG, 205767_at) and Amphiregulin (AREG, 205239_at) are plotted on the y axis. There is a statistically significant difference in gene expression levels between the disease control group (CR, PR and SD) and the non-responder group (EREG p=$1.474e^{-05}$, AREG p=$2.489e^{-05}$). These results suggest that patients who have high levels of EREG and AREG have tumors that are addicted to the EGFR signaling pathway and are therefore most likely to experience disease control on treatment with cetuximab.

In addition to the gene filtering approach described above, a de novo analysis was performed on the transcriptional profiles of the same 80 patients. A two-sided unequal-variance t-test was done on all 17,137 probe sets. The top 10 genes are provided in Table 5.

Examination of the top 10 genes with the lowest p value revealed that EREG and AREG were once again found to be top sensitivity markers. CD73, dual specificity phosphatase 4 (DUSP4, 204015_s_at and 204014_at), and pleckstrin homology like domain A1 (PHLDA1, 217999_s_at) were found to be top resistance markers. The mRNA expression levels of epidermal growth factor (EGF, 206254_at), transforming growth factor alpha (TGFα, 205016_at), betacellulin (BTC, 207326_at) and heparin binding-EGF (HB-EGF, 203821_at), some of the other known ligands for EGFR, were also reviewed. Their expression levels showed no correlation with response to cetuximab. It is also worth noting that no correlation was seen between EGFR (201983_s_at) mRNA levels and response to cetuximab. These results suggest that a de novo analysis using only the transcriptional profiling data gathered from this clinical study could find the candidate markers EREG and AREG. However, given the issue of multiple test comparisons, the identification of EREG and AREG using an independent filtering approach described above lends additional support to their being candidates for predicting cetuximab response.

From the t-test analyses, the ability of individual biomarkers to separate the disease control group from the non-responders could be assessed. Using discriminant function analysis, the prediction power of a set of the 100 top candidate markers for patient response was assessed in order to identify the set of variables that would be the best predictors of disease control with cetuximab treatment. The AUC (area under the

TABLE 5

Top 10 Genes from De Novo Analysis

Figure 8A:
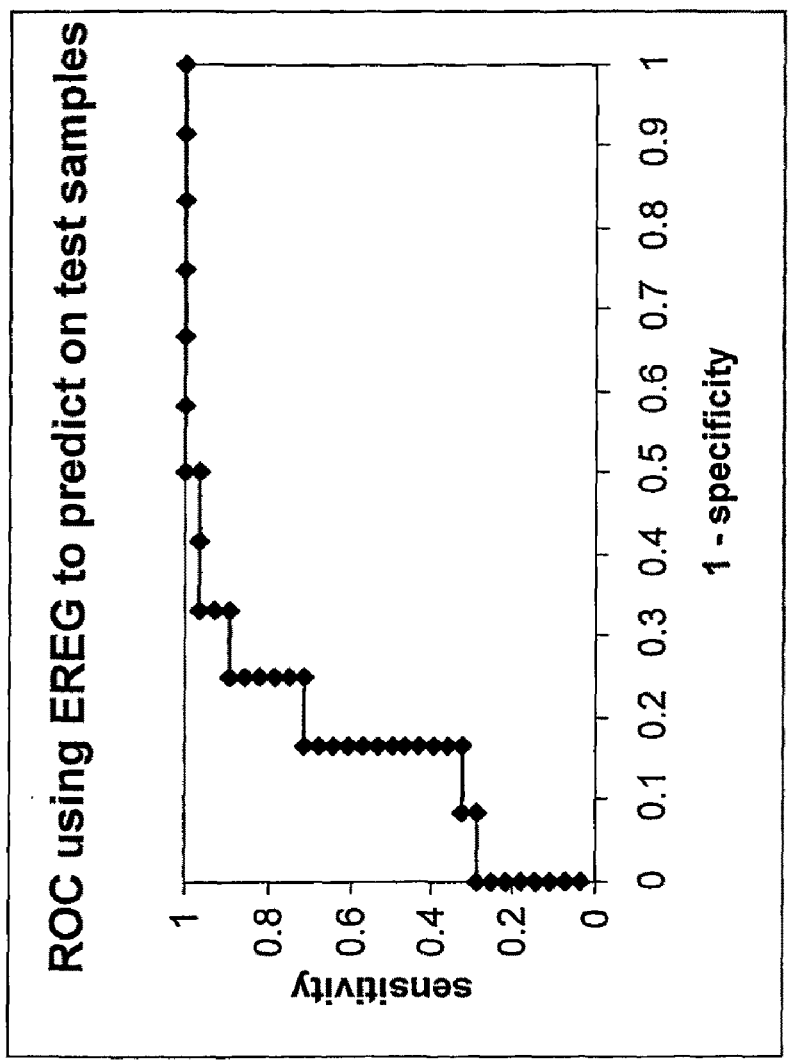
FIG. 8A provides ROC using EREG to predict on test samples. EREG was the top single gene predictor using the discriminant function analysis, and has an area under the ROC curve (AUC) of 0.845 on the test set, indicating a high performance for prediction.
Figure 8B:
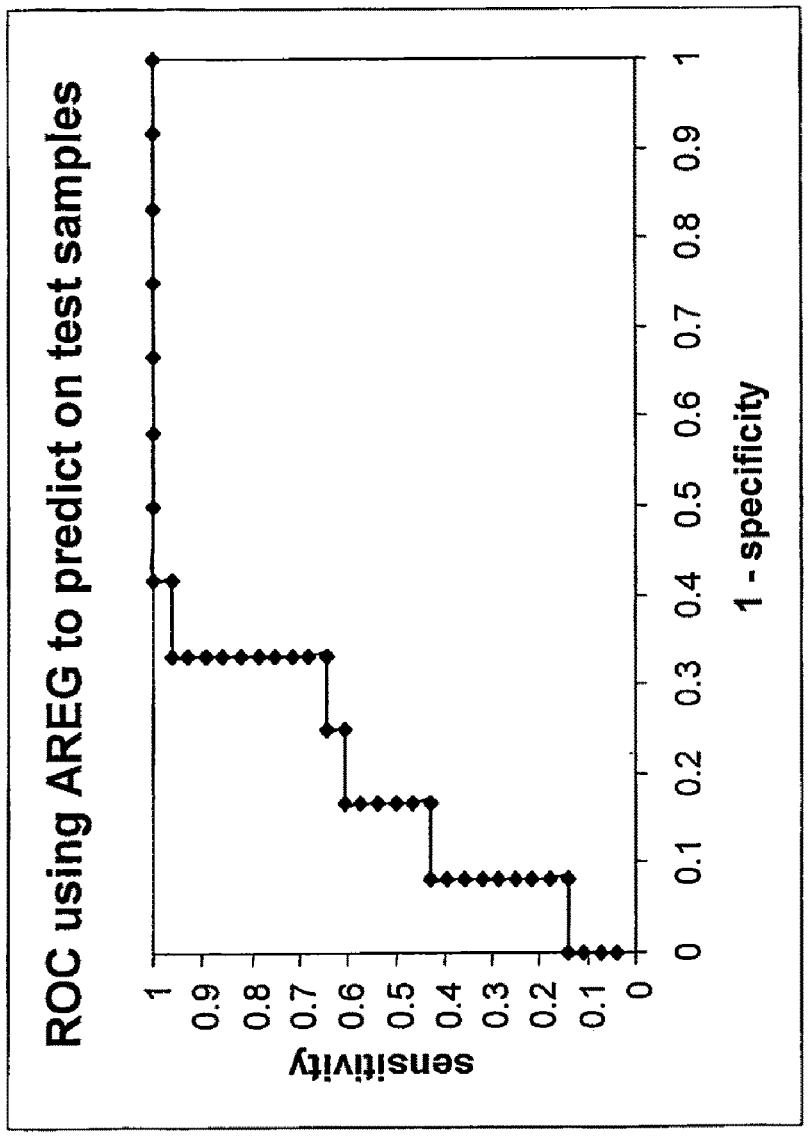
FIG. 8B provides ROC using AREG to predict on the test set. The AREG gene, which was found to be coordinately regulated with the EREG gene, has an AUC of 0.815 on the test set, indicating that it too has a good prediction power as a single gene predictor.

| Affymetrix ID | p value | Gene name | Symbol |
|---|---|---|---|
| 203939_at | 3.787E−07 | 5'-nucleotidase, ecto (CD73) | NT5E |
| 217999_s_at | 7.056E−06 | Pleckstrin homology-like domain, family A, member 1 | PHLDA1 |
| 205767_at | 1.474E−05 | epiregulin | EREG |
| 203349_s_at | 1.704E−05 | ets variant gene 5 (ets-related molecule) | ETV5 |
| 204015_s_at | 1.812E−05 | dual specificity phosphatase 4 | DUSP4 |
| 204014_at | 1.856E−05 | dual specificity phosphatase 4 | DUSP4 |
| 212349_at | 2.395E−05 | protein O-fucosyltransferase 1 | POFUT1 |
| 205239_at | 2.489E−05 | amphiregulin (schwannoma-derived growth factor) | AREG |
| 208130_s_at | 2.646E−05 | thromboxane A synthase 1 (platelet, cytochrome P450, family 5, subfamily A) /// thromboxane A synthase 1 (platelet, cytochrome P450, family 5, subfamily A) | TBXAS1 |
| 219615_s_at | 3.153E−05 | potassium channel, subfamily K, member 5 | KCNK5 | receiver operating characteristic curve) values of the different multi-gene models showed that as the number of genes in the model increased from one to fifteen the predictive power of the model did not improve. The AUC value of a single gene model was >0.8. An independent test was done to assess the performance of the most frequently identified gene, EREG, and also of AREG, as individual predictors. EREG has an AUC value of 0.845, and AREG has an AUC value of 0.815, indicating that they are both highly powerful predictive markers for patient selection (FIGS. 8A and 8B).

Analysis of Candidate Markers Epiregulin and Amphiregulin:

In order to independently verify gene expression with a different technology platform that may ultimately be more easily transferable into a diagnostic test, AREG and EREG transcript levels were measured using quantitative RT-PCR TaqMan assays. Expression levels of these genes were obtained for tumor samples from 73 of the subjects using both array-based and qRT-PCR methods (Table 6).

TABLE 6

Expression Levels of Amphiregulin and Epiregulin by quantitative RT-PCR TaqMan Assays

| Best Clinical Response Assessment | AffyQ AREG expression | AffyQ EREG expression | qRT-PCR AREG dCt | qRT-PCR EREG dCt | KRAS Mutation codon base change | KRAS Mutation amino acid change | Order of sample on FIG. 7 |
|---|---|---|---|---|---|---|---|
| CR | 2573.74 | 1659.91 | 5.80 | 5.32 | | | 1 |
| PD | 949.81 | 450.25 | 7.79 | 7.20 | WT | | 36 |
| SD | 3353.93 | 2336.8 | 9.58 | 8.89 | c.35G>T | G12V | 7 |
| SD | 105.82 | 89.23 | 9.35 | 9.31 | WT | | 8 |
| UTD | 1581.54 | 603.27 | 6.48 | 6.20 | c.35G>A | G12D | 73 |
| SD | | | | | | | |
| PD | 1626.87 | 668.84 | 5.40 | 5.48 | c.35G>T | G12V | 32 |
| PD | 122.3 | 46.36 | | | | | 58 |
| UTD | 321.51 | 56.59 | 9.20 | 9.31 | c.35G>A | G12D | 69 |
| SD | | | | | | | |
| SD | | | | | | | |
| PD | 177.95 | 128.85 | 9.01 | 8.76 | c.35G>A | G12D | 67 |
| PD | 2550.49 | 655.04 | 4.57 | 5.64 | WT | | 30 |
| PR | 3974.98 | 1108.91 | 3.23 | 4.38 | WT | | 2 |
| PD | 1084.91 | 622.01 | 5.35 | 5.46 | WT | | 26 |
| PD | 611.84 | 573.66 | 6.17 | 5.60 | WT | | 47 |
| SD | 955.24 | 292.33 | 6.22 | 7.30 | WT | | 11 |
| PR | 5083.12 | 1166.18 | | | WT | | 5 |
| PD | | | | | | | |
| SD | 2481.22 | 1154.9 | 4.56 | 4.99 | WT | | 12 |
| SD | 2527.86 | 1395.95 | 5.37 | 4.35 | WT | | 13 |
| SD | | | | | WT | | |
| PD | | | | | c.35G>A | G12D | |
| PD | 402.53 | 419.27 | 9.34 | 6.14 | c.35G>A | G12D | 62 |
| PR | 3395.09 | 1447.49 | 3.76 | 4.14 | WT | | 3 |
| PD | 2134.23 | 906.03 | 7.11 | 6.45 | c.35G>T | G12V | 37 |
| PD | 1163.17 | 100.48 | 6.39 | 9.52 | c.35G>T | G12V | 27 |
| UTD | 1086.48 | 113.14 | UTD | UTD | WT | | 70 |
| UTD | 301.36 | 241.05 | 8.82 | 8.30 | WT | | 74 |
| SD | 4414.67 | 1331.61 | 3.77 | 4.67 | WT | | 14 |
| SD | 609.57 | 62.96 | | | c.35G>A | G12D | 15 |
| PD | | | | | WT | | |
| PD | 901.86 | 459.6 | 8.30 | 7.43 | WT | | 68 |
| PD | | | | | WT | | |
| PR | 3332.21 | 2042.92 | 5.17 | 3.47 | WT | | 6 |
| PD | 42.03 | 78.71 | 11.81 | 9.19 | WT | | 48 |
| SD | | | | | WT | | |
| PD | | | | | c.35G>C | G12A | |
| PR | 1418.75 | 2411.15 | 4.91 | 3.40 | WT | | 4 |
| UTD | 872.72 | 469.76 | 6.32 | 5.55 | c.35G>A | G12D | 71 |
| SD | 1384.71 | 632.61 | 5.75 | 5.60 | na | | 9 |
| PD | 503.53 | 206.2 | 6.83 | 7.10 | na | | 59 |
| PD | 75.64 | 50.98 | 10.33 | 9.52 | | | 61 |
| PD | 1879.09 | 587.4 | 7.50 | 7.25 | na | | 41 |
| PD | 471.68 | 36.46 | 5.60 | 4.77 | | | 34 |
| PD | 39.27 | 8.15 | 12.33 | 13.18 | WT | | 55 |
| PD | 111.94 | 107.83 | 10.02 | 8.30 | WT | | 43 |
| PD | | | | | na | | |
| PR | | | | | na | | |
| PD | 1464.45 | 298.7 | 5.94 | 7.16 | WT | | 51 |
| SD | 5533.18 | 2232.8 | | | na | | 10 |
| PD | 236.8 | 42.59 | 8.96 | UTD | | | 54 |
| SD | 1416.68 | 819.85 | | | WT | | 16 |
| PD | 719.16 | 550.72 | 6.38 | 5.90 | c.35G>A | G12D | 42 |
| PD | | | | | | | |
| UTD | 127.95 | 12.85 | 9.86 | 10.64 | c.35G>A | G12D | 72 |

TABLE 6-continued

Expression Levels of Amphiregulin and Epiregulin by quantitative RT-PCR TaqMan Assays

| Best Clinical Response Assessment | AffyQ AREG expression | AffyQ EREG expression | qRT-PCR AREG dCt | qRT-PCR EREG dCt | KRAS Mutation codon base change | KRAS Mutation amino acid change | Order of sample on FIG. 7 |
|---|---|---|---|---|---|---|---|
| PD | 331.54 | 307.55 | 8.22 | 6.83 | WT | | 33 |
| PD | 936.71 | 64.49 | 8.28 | 10.95 | WT | | 65 |
| PD | 132.01 | 28.72 | 10.55 | 12.04 | c.35G > A | G12D | 35 |
| UTD | 760.08 | 221.16 | 6.27 | 8.55 | | | 75 |
| PD | 162.74 | 71.16 | 10.21 | 11.17 | WT | | 28 |
| UTD | 865.02 | 258.5 | 7.95 | 8.94 | c.34G > A | G12S | 76 |
| PD | 489.57 | 224.81 | 8.17 | 7.70 | c.35G > T | G12V | 46 |
| PD | 813.24 | 529.95 | 7.16 | 6.79 | c.35G > A | G12D | 38 |
| PD | | | | | | | |
| PD | | | | | | | |
| PD | 1556.84 | 703.23 | 5.70 | 5.40 | c.35G > C | G12A | 60 |
| SD | | | | | | | |
| PD | 1646.55 | 1127.43 | 6.44 | 5.39 | WT | | 57 |
| PD | | | | | | | |
| PD | 27.71 | 1.05 | 13.23 | UTD | WT | | 56 |
| PD | 1182.47 | 76.66 | 7.48 | 10.91 | c.34G > A | G12S | 50 |
| PD | | | | | | | |
| PD | 532.55 | 171.22 | 8.87 | 8.79 | c.35G > C | G12A | 45 |
| PD | 12.43 | 13.62 | UTD | 13.67 | WT | | 63 |
| SD | 2809.16 | 804.93 | 6.13 | 5.20 | WT | | 17 |
| UTD | 1656.76 | 665.01 | 6.14 | 5.07 | c.38G > A | G13D | 77 |
| SD | 18.88 | 2.2 | 10.67 | 12.31 | WT | | 18 |
| SD | 1479.28 | 799.93 | 5.74 | 6.28 | WT | | 19 |
| PD | 1034.32 | 384.07 | 6.64 | 7.29 | WT | | 53 |
| UTD | 24.18 | 15.47 | UTD | UTD | WT | | 78 |
| UTD | 54.13 | 11.49 | 9.44 | 11.32 | WT | | 79 |
| SD | 1554.57 | 646.2 | 5.23 | 5.86 | WT | | 20 |
| SD | 3536.88 | 1764.91 | 5.82 | 3.45 | WT | | 21 |
| SD | | | | | WT | | |
| SD | 6390.33 | 3078.94 | 3.47 | 4.02 | WT | | 22 |
| PD | | | | | | | |
| PD | 801.39 | 486.2 | 6.81 | 7.14 | WT | | 40 |
| SD | | | | | c.35G > A | G12D | |
| UTD | 1945.99 | 240.5 | 8.21 | 10.16 | c.38G > A | G13D | 80 |
| PD | 1984.72 | 897.89 | 4.21 | 4.31 | c.35G > T | G12V | 64 |
| SD | 5830.27 | 1980.37 | 2.58 | 3.11 | WT | | 23 |
| PD | 2321 | 784.77 | 5.41 | 5.21 | c.35G > T | G12V | 29 |
| PD | | | | | WT | | |
| PD | 1095.66 | 468.77 | 9.03 | 7.75 | c.38G > A | G13D | 66 |
| PD | 442.29 | 77.8 | 9.84 | 10.39 | c.35G > A | G12D | 49 |
| SD | 1610.75 | 442.09 | 5.25 | 6.21 | WT | | 24 |
| SD | 2615.62 | 1113.89 | 5.67 | 7.03 | WT | | 25 |
| PD | 1737.75 | 694.22 | 6.05 | 7.01 | WT | | 44 |
| SD | | | | | WT | | |
| PD | 2271.37 | 634.05 | 5.32 | 5.61 | c.35G > A | G12D | 39 |
| PD | 1858.06 | 870.14 | 6.27 | 6.34 | c.35G > A | G12D | 52 |
| PD | 1018.25 | 859.41 | 8.08 | 5.91 | WT | | 31 |

Figure 9:
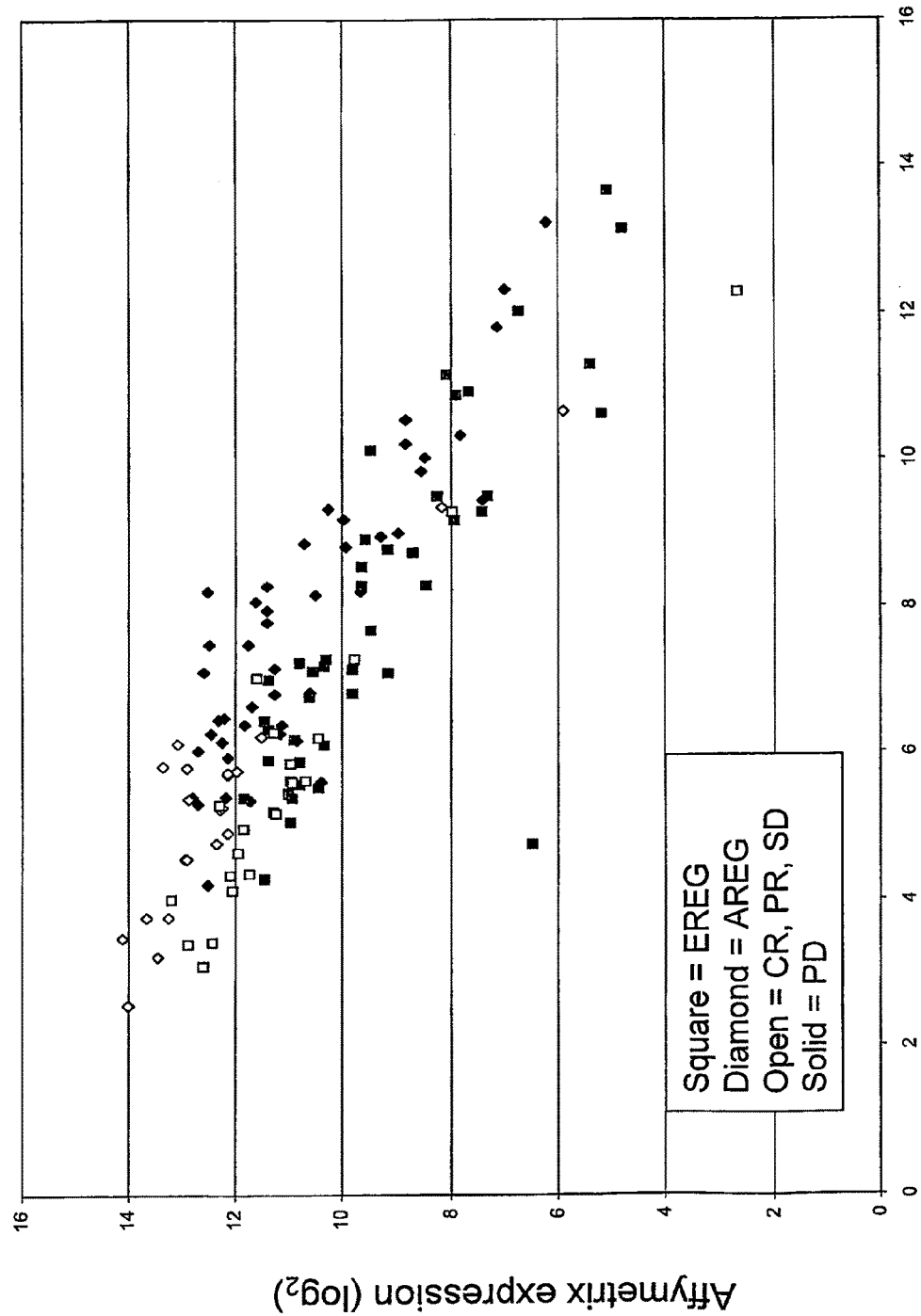
FIG. 9 illustrates the results obtained from validation of AREG and EREG Affymetrix expression by qRT-PCR. A good correlation between the two methods (Pearson>0.85, R2>0.7) was seen. High expression on Affymetrix arrays (y axis) corresponds to low ΔCt values from TaqMan qPCR assays for both AREG and EREG (x axis).

There was good correlation between the two methods (for log$_2$-transformed array data, Pearson >0.85, $R^2$>0.7), with high expression on Affymetrix arrays corresponding to low ΔCt values from TaqMan assays for both amphiregulin and epiregulin (FIG. 9).

Genetic Analysis of DNA Isolated from Tumor Biopsies and Whole Blood:

Somatic mutations in the EGFR tyrosine kinase domain are found to be strongly associated with sensitivity to gefitinib and erlotinib in NSCLC (Janne et al., J. Clin. Oncol., 23, 3227-3234 (2005)). It has been reported that somatic mutations in the EGFR TK domain are not required for response to cetuximab, nor do they appear to be predictive of response to cetuximab (Tsuchihashi et al., N. Engl. J. Med., 353, 208-209 (2005)). Somatic mutations in K-RAS are associated with a lack of sensitivity to gefitinib and erlotinib in NSCLC but their role in cetuximab sensitivity in CRC is unclear (Moroni et al., Lancet Oncol., 6, 279-286 (2005); Pao et al., PLoS Med., 2, e17 (2005)). DNA from 80 tumor biopsies was evaluated for mutations in EGFR, K-RAS and BRAF. Not a single heterozygous mutation was detected in either the EGFR kinase domain or in exon 15 of the BRAF gene. K-RAS exon 2 mutations affecting codon 12 and 13 were detected in 30 out of 80 (38%) analyzed samples (Table 6). K-RAS mutations were detected in only 3 Stable Disease patients out of the 27 Disease Control Group (5 PR and 22 SD) patients tested (11%). On the other hand, K-RAS mutations were detected in 27 out of 53 non-responders (51%). The data clearly show that the presence of a K-RAS mutation correlates with a lack of response to cetuximab therapy.

Discussion:

The key findings from the analysis of pre-treatment biopsies are that patients whose tumors express high levels of the EGFR ligands epiregulin and amphiregulin are most likely to benefit from cetuximab therapy. In addition, it was found that patients whose tumors do not have K-RAS mutations have a significantly higher disease control rate than those with K-RAS mutations.

The genes for the EGFR ligands epiregulin and amphiregulin are co-localized on chromosome 4q13.3 (Conti et al., Mol. Endocrinol., 20, 715-723 (2006)). It was observed that the expression of epiregulin and amphiregulin was coordinately regulated (Pearson correlation=0.85). Epiregulin is known to bind more weakly to EGFR and ERBB4 than the EGF ligand, but is a much more potent mitogen than EGF and leads to a prolonged state of receptor activation (Shelly et al., J. Biol. Chem., 273, 10496-10505 (1998)). Elevated expression of epiregulin and/or amphiregulin may play an important role in tumor growth and survival by stimulating an autocrine loop through EGFR. This may characterize a tumor that is "EGFR-dependent" and therefore sensitive to the ability of cetuximab to block ligand-receptor interaction. The observations that constitutive epiregulin and amphiregulin expression in L2987 cells is decreased upon EGFR inhibitor treatment, is stimulated by EGF treatment, and that cetuximab treatment blocks L2987 cell growth, support the hypothesis that these EGFR ligands are beacons of an activated EGFR pathway and perhaps autocrine stimulators. This hypothesis is also supported by results in a lung cancer mouse model in which high expression of epiregulin and amphiregulin, as well as ERBB3, was dependent on EGFR activation (Fujimoto et al., Cancer Res., 65, 11478-11485 (2005)).

It is not surprising that the findings of epiregulin and amphiregulin RNA expression was not translated into protein-based assays. The mRNA transcripts may code for the membrane-anchored precursor forms that are eventually cleaved to generate soluble forms. In the case of amphiregulin, it has been shown that the membrane-anchored isoform, as well as the soluble form, are biologically active and may induce juxtacrine, autocrine or paracrine signaling (Singh and Harris, Cell Signal, 17, 1183-1193 (2005)). It is interesting to note that in contrast to these findings, elevated serum levels of amphiregulin and TGFα have been reported to predict poor response to gefitinib in patients with advanced NSCLC. (Ishikawa et al., Cancer Res., 65, 9176-9184 (2005)). It remains to be determined whether the tumors of the patients with high serum levels of amphiregulin and TGFα described in that study may have other genetic aberrations such as K-RAS mutation that may allow by-pass of their dependence on EGFR signaling for growth and survival.

Epiregulin and amphiregulin can be used to identify other tumor types that might be sensitive to cetuximab. Epiregulin and amphiregulin expression is increased in androgen-independent prostate cancer cells and after castration in an androgen-sensitive prostate cancer xenograft (Torring et al., Prostate, 64, 1-8 (2005); Torring et al., Anticancer Res., 20, 91-95 (2000)). Epiregulin expression is higher in pancreatic cancer where it stimulates cell growth (Zhu et al., Biochem. Biophys. Res. Commun., 273, 1019-1024 (2000)) and in bladder cancer patients where it is correlated with survival (Thogersen et al., Cancer Res., 61, 6227-6233 (2001)). The enhanced expression of amphiregulin is found to be significantly correlated with overall survival in non-small cell lung cancer (NSCLC) (Fontanini et al., Clin. Cancer Res., 4, 241-249 (1998)). Amphiregulin expression is higher in multiple myeloma cells expressing ERBB receptors and promotes their growth (Mahtouk et al., Oncogene, 24, 3512-3524 (2005)). Recently, it has been found that high levels of lutenizing hormone may elevate the risk of ovarian and breast cancers through the stimulation of epiregulin and amphiregulin which in turn could stimulate mitogenic EGFR signaling (Freimann et al., Biochem. Pharmacol., 68, 989-996 (2004)).

Finally, the observation that EGFR and estrogen receptor (ERα) mediate expression of amphiregulin (Britton et al., Breast Cancer Res. Treat., 96, 131-146 (2006)) suggests that a subset of breast cancer patients (EGFR+, ER+, amphiregulin+) may benefit from cetuximab therapy. It is notable that among metastatic breast cancer patients treated with the EGFR inhibitor gefitinib in combination with taxotere, significantly better response rates were seen in ER positive than in ER negative tumors (Ciardiello et al., Br. J. Cancer, 94, 1604-1609 (2006)).

In addition to the observation that the two EGFR ligands are predictive of response to cetuximab, it was found that patients without K-RAS mutations have a higher disease control rate (48%) than those with K-RAS mutations (10%). This result confirms findings from a recently reported study that shows that patients without K-RAS mutations have a higher disease control rate (76%) than those with K-RAS mutations (31%) (Lievre et al., Cancer Res., 66, 3992-3995 (2006)). Interestingly, a majority of the patients described in the previous study were treated with a combination of cetuximab and chemotherapy, suggesting that the K-RAS mutations are predictive of disease progression in both the monotherapy and combination therapy settings. K-RAS plays a crucial role in the RAS/MAPK pathway, which is located downstream of EGFR and other growth factor receptors, and is involved in cell proliferation. The presence of activating mutations in K-RAS might be expected to circumvent the inhibitory activity of cetuximab. K-RAS mutations have also been found to be associated with resistance to gefitinib and erlotinib in NSCLC (Pao et al., PLoS Med., 2, e17 (2005)). These data consistently support the role of K-RAS mutations in predicting response to cetuximab and/or other EGFR inhibitors, and should continue to be evaluated in cancers where RAS mutations are prevalent such as CRC, NSCLC and pancreatic cancer (Minamoto et al., Cancer Detect. Prev., 24, 1-12 (2000)).

In contrast to what has been observed in patients with NSCLC (Janne et al., J. Clin. Oncol., 23, 3227-3234 (2005)), mutations in the EGFR gene (exons 18-21) in the patients enrolled in this CRC study were not detected, confirming the paucity of mutations in patients with CRC (Tsuchihashi et al., N. Engl. J. Med., 353, 208-209 (2005)). Mutations in BRAF (exon 15) were not detected, though such mutations have been observed at a low frequency (<5%) in other studies (Moroni et al., Lancet Oncol., 6, 279-286 (2005)). An increase in EGFR gene copy number was observed in less than 10% of the patients evaluated in this study and while there was a trend towards higher copy number in the patients with disease control, the result was more in line with that of Lievre et al (10% of patients had amplification) than with Moroni et al (31% of patients had amplification). Assessment of the performance of a model using the combination of K-RAS mutation status and epiregulin mRNA expression levels showed excellent prediction power (AUC value of 0.89).

Example 3

Production of Antibodies Against the Biomarkers

Antibodies against the biomarkers can be prepared by a variety of methods. For example, cells expressing a biomarker polypeptide can be administered to an animal to induce the production of sera containing polyclonal antibodies directed to the expressed polypeptides. In one aspect, the biomarker protein is prepared and isolated or otherwise purified to render it substantially free of natural contaminants, using techniques commonly practiced in the art. Such a preparation is then introduced into an animal in order to produce polyclonal antisera of greater specific activity for the expressed and isolated polypeptide.

In one aspect, the antibodies of the invention are monoclonal antibodies (or protein binding fragments thereof). Cells expressing the biomarker polypeptide can be cultured in any suitable tissue culture medium, however, it is preferable to culture cells in Earle's modified Eagle's medium supplemented to contain 10% fetal bovine serum (inactivated at about 56° C.), and supplemented to contain about 10 g/l nonessential amino acids, about 1.00 U/ml penicillin, and about 100 μg/ml streptomycin.

The splenocytes of immunized (and boosted) mice can be extracted and fused with a suitable myeloma cell line. Any suitable myeloma cell line can be employed in accordance with the invention, however, it is preferable to employ the parent myeloma cell line (SP2/0), available from the ATCC (Manassas, Va.). After fusion, the resulting hybridoma cells are selectively maintained in HAT medium, and then cloned by limiting dilution as described by Wands et al. (1981, *Gastroenterology*, 80:225-232). The hybridoma cells obtained through such a selection are then assayed to identify those cell clones that secrete antibodies capable of binding to the polypeptide immunogen, or a portion thereof.

Alternatively, additional antibodies capable of binding to the biomarker polypeptide can be produced in a two-step procedure using anti-idiotypic antibodies. Such a method makes use of the fact that antibodies are themselves antigens and, therefore, it is possible to obtain an antibody that binds to a second antibody. In accordance with this method, protein specific antibodies can be used to immunize an animal, preferably a mouse. The splenocytes of such an immunized animal are then used to produce hybridoma cells, and the hybridoma cells are screened to identify clones that produce an antibody whose ability to bind to the protein-specific antibody can be blocked by the polypeptide. Such antibodies comprise anti-idiotypic antibodies to the protein-specific antibody and can be used to immunize an animal to induce the formation of further protein-specific antibodies.

Example 4

Immunofluorescence Assays

The following immunofluorescence protocol may be used, for example, to verify EGFR biomarker protein expression on cells or, for example, to check for the presence of one or more antibodies that bind EGFR biomarkers expressed on the surface of cells. Briefly, Lab-Tek II chamber slides are coated overnight at 4° C. with 10 micrograms/milliliter (μg/ml) of bovine collagen Type II in DPBS containing calcium and magnesium (DPBS++). The slides are then washed twice with cold DPBS++ and seeded with 8000 CHO-CCR5 or CHO pC4 transfected cells in a total volume of 125 μl and incubated at 37° C. in the presence of 95% oxygen/5% carbon dioxide.

The culture medium is gently removed by aspiration and the adherent cells are washed twice with DPBS-++ at ambient temperature. The slides are blocked with DPBS-++ containing 0.2% BSA (blocker) at 0-4° C. for one hour. The blocking solution is gently removed by aspiration, and 125 μl of antibody containing solution (an antibody containing solution may be, for example, a hybridoma culture supernatant which is usually used undiluted, or serum/plasma which is usually diluted, e.g., a dilution of about 1/100 dilution). The slides are incubated for 1 hour at 0-4° C. Antibody solutions are then gently removed by aspiration and the cells are washed five times with 400 μl of ice cold blocking solution. Next, 125 μl of 1 μg/ml rhodamine labeled secondary antibody (e.g., anti-human IgG) in blocker solution is added to the cells. Again, cells are incubated for 1 hour at 0-4° C.

The secondary antibody solution is then gently removed by aspiration and the cells are washed three times with 400 μl of ice cold blocking solution, and five times with cold DPBS++. The cells are then fixed with 125 μl of 3.7% formaldehyde in DPBS++ for 15 minutes at ambient temperature. Thereafter, the cells are washed five times with 400 μl of DPBS++ at ambient temperature. Finally, the cells are mounted in 50% aqueous glycerol and viewed in a fluorescence microscope using rhodamine filters.

SEQUENCE LISTING (260 sequences)

SEQ ID NO: 1 - DNA, 3547 bp, Homo sapiens
gcactcgcccggctcgcccgctttcgcacccagttcacgcgccacagctatgtgtccccgagccgcgcgggcgcccgcgacgctactcctcgccctgggcgcggtgctgtggcctgcggctggcgcctgggagcttacgattttgcacaccaacgacgtgcacagccggctggagcagaccagcgaggactccagcaagtgcgtcaacgccagccgctgcatgggtggcgtggctcggctcttcaccaaggttcagcagatccgccgcgccgaacccaacgtgctgctgctggacgccggcgaccagtaccagggcactatctggttcaccgtgtacaagggcgccgaggtggcgcacttcatgaacgccctgcgctacgatgccatggcactgggaaatcatgaatttgataatggtgtggaaggactgatcgagccactcctcaaagaggccaaatttccaattctgagtgcaaacattaaagcaaaggggccactagcatctcaaatatcaggactttatttgccatataaagttcttcctgttggtgatgaagttgtgggaatcgttggatacacttccaaagaaaccccttttctctcaaatccagggacaaatttagtgtttgaagatgaaatcactgcattacaacctgaagtagataagttaaaaactctaaatgtgaacaaaattattgcactgggacattcgggttttgaaatggataaactcatcgctcagaaagtgaggggtgtggacgtcgtggtgggaggacactccaacacatttctttacacaggcaatccaccttccaaagaggtgcctgctgggaagtacccattcatagtcacttctgatgatgggcggaaggttcctgtagtccaggcctatgcttttggcaaatacctaggctatctgaagatcgagtttgatgaaagaggaaacgtcatctcttcccatggaaatcccattcttctaaacagcagcattcctgaagatccaagcataaaagcagacattaacaaatggaggataaaattggataattattctacccaggaattagggaaaacaattgtctatctggatggctcctctcaatcatgccgctttagagaatgcaacatgggcaacctgatttgtgatgcaatgattaacaacaacctgagacacacggatgaaatgttctggaaccacgtatccatgtgcattttaaatggaggtggtatccggtcgcccattgatgaacgcaacaatggcacaattacctgggagaacctggctgctgtattgccctttggaggcacatttgacctagtccagttaaaaggttccaccctgaagaaggcctttgagcatagcgtgcaccgctacggccagtccactggagagttcctgcaggtgggcggaatccatgtggtgtatgatctttcccgaaaacctggagacagagtagtcaaattagatgttctttgcaccaagtgtcgagtgcccagttatgaccctctcaaaatggacgaggtatataaggtgatcctcccaaacttcctggccaatggtggagatgggttccagatgataaaagatgaattattaagacatgactctggtgaccaagatatcaacgtggtttctacatatatctccaaaatgaaagtaatttatccagcagttgaaggtcggatcaagttttccacaggaagtcactgccatggaagcttttctttaatatttctttcactttgggcagtgatctttgttttataccaatagccaaaaattctccttgcctttaatgtgtgaaactgcattttttcaagtgagattcaaatctgccttttaggacctggctttgtgacagcaaaaaccatctttacaggctcctagaagctgaaggttagagcattataaaatgaagagacagacatgattactcagggtcagcaacctagtgagttagaaaaaaaattaacatagggccctataaggagaaagccaactatgttaagtttacgtgtccaaattttaatgaaattttactaacaattttaaaccatatttttcttcttcatatccatttctaatccatcaaacagcttatgtttacataaaattttatcattcacaaggaagttttaagcacactgtctcatttgatatccacaacttatttttggtaggaaagagagatgtttttcccacctgtcagatgaaaaaactgaagctcaaaaagggttgacttgaccatacagctaatgctgacagatccaagacctagacctaggtcttttgaactcaagtccagcattctcaactatatcaagttactgttcagaatacttaatatctcctctcttcataattatcaatagccccaagctcatggatgacaaatctctgctttatttcttgtctctattttttcactttatagctcctgttataatagcaagtttaatggtataaacacaggataccatcctctcttgcaacacccatgtgcctttgatgagtcaggtagcaagctgtagtagataatgagaaaggccagaggctgcaaagacagtcaaaggacacgagagaaaggaaggggaagaacaggactccaggactgttttatattatagaaaagcaagagctaaagagcatttacacatgttaaacagatacttgttaagcatagtgcctgacacacggcattagctgttattttatgagattccatcagctctgcctctgtcctctttcttctaacatgaaggtatcatgagaagagaaccttctaacataagctgtaattctaaacctgcacttgtccctctccagcaagaggctagcactgaattcattctactcatactacacacccagttatggaatgtccagagttctcgaagaaaataaatgactttaggaagaggtatacattttttaagtcgctctgcctccaaatctgaacagtcactgtaaatcattcttaagcccagatatgagaacttctgctggaaagtgggaccctctgagtgggtggtcagaaaatacccatgctgatgaaatgacctatgcccaaagaacaaatacttaacgtgggagtggaaccacatgagcctgctcagctctgcataagtaattcaagaaatgggaggcttcaccttaaaaacagtgtgcaaatggcagctagaggttttgataggaagtatgtttgtttcttagtgtttacaaatattaagtactcttgatacaaaatatacttttaaacttcataacctttttataaaagttgttgcagcaaaataatagcctcggttctatgcatatatggattgctataaaaaatgtcaataagattgtacaaggaaaattagagaaagtcacatttagggtttattttttacacttggccagtaaaatagggtaaatcctattagaaattttttaaagaactttttttaagtttcctaaatctgtgtgtgtattgtgaagtggtataagaaatgactttgaaccactttgcaattgtagattcccaacaataaaattgaagat

SEQ ID NO: 2 - DNA, 4627 bp, Homo sapiens
tcacttgcctgatatttccagtgtcagagggacacagccaacgtggggtcccttctaggctgacagccgctctccagccactgccgcgagcccgtctgctcccgccctgcccgtgcactctccgcagccgccctccgccaagccccagcgcccgctcccatcgccgatgaccgcggggaggaggatggagatgctctgtgccggcagggtccctgcgctgctgctctgcctgggtttccatcttctacaggcagtcctcagtacaactgtgattccatcatgtatcccaggagagtccagtgataactgcacagctttagttcagacagaagacaatccacgtgtggctcaagtgtcaataacaaagtgtagctctgacatgaatggctattgtttgcatggacagtgcatctatctggtggacatgagtcaaaactactgcaggtgtgaagtgggttatactggtgtccgatgtgaacacttctttttaaccgtccaccaacctttaagcaaagagtatgtggctttgaccgtgattcttattattttgtttcttatcacagtcgtcggttccacatattatttctgcagatggtacagaaatcgaaaaagtaaagaaccaaagaaggaatatgagagagttacctcaggggatccagagttgccgcaagtctgaatggcgccatcaaacttatgggcagggataacagtgtgcctggttaatattaatattccattttattaataatatttatgttgggtcaagtgttaggtcaataacactgtattttaatgtacttgaaaaatgtttttatttttgttttatttttgacagactatttgctaatgtataatgtgcagaaaatatttaatatcaaaagaaaattgatatttttatacaagtaatttcctgagctaaatgcttcattgaaagcttcaaagtttatatgcctggtgcacagtgcttagaagtaagcaattcccaggtcatagctcaagaattgttagcaaatgacagatttctgtaagcctatatatatagtcaaatcgatttagtaagtatgttttttatgttcctcaaatcagtgataattggtttgactgtaccatggtttgatatgtagttggcaccatggtatcatatattaaaacaataatgcaattagaatttgggagaagcaaatataggtcctgtgttaaacactacacatttgaaacaagctaaccctggggagtctatggtctcttcactcaggtctcagctataattctgttatatgaggggcagtggacagttccctatgccaactcacgactcctacaggtactagtcactcatctaccagattctgcctatgtaaaatgaattgaaaaacaattttctgtaatcttttatttaagtagtgggcatttcatagcttcacaatgttccttttttgtatattacaacatttatgtgaggtaattattgctcaacagacaattagaaaaaagtccacacttgaagcctaaatttgtgctttttaagaatatttttagactatttctttttataggggctttgctgaattctaacattaaatcacagcccaaaatttgatggactaattattattttaaaatatatgaagacaataattctacatgttgtcttaagatggaaatacagttatttcatcttttattcaaggaagttttaactttaatacagctcagtaaatggcttcttctagaatgtaaagttatgtatttaaagttgtatcttgacacaggaaatgggaaaaaacttaaaaattaatatggtgtatttttccaaatgaaaaatctcaattgaaagcttttaaaatgtagaaacttaaacacaccttcctgtggaggctgagatgaaaactagggctcattttcctgacatttgtttattttttggaagagacaaagatttcttctgcactctgagcccataggtctcagagagttaataggagtatttttgggctattgcataaggagccactgctgccaccacttttggattttatgggaggctccttcatcgaatgctaaacctttgagtagagtctccctggatcacataccaggtcagggaggatctgttcttcctctacgtttatcctggcatgtgctagggtaaacgaaggcataataagccatggctgacctctggagcaccaggtgccaggacttgtctccatgtgtatccatgcattatataccctggtgcaatcacacgactgtcatctaaagtcctggccctggcccttactattaggaaaataaacagacaaaaacaagtaaatatatatggtcctatacatattgtatatatattcatatacaaacatgtatgtatacatgaccttaatggatcatagaattgcagtcatttggtgctctgctaaccatttatataaaacttaaaaacaagagaaaagaaaaatcaattagatctaaacagttatttctgtttcctatttaatatagctgaagtcaaaatatgtaagaacacattttaaatactctacttacagttggccctctgtggttagttccacatctgtggattcaaccaaccaaggacggaaaatgcttaaaaaataatacaacaacaacaaaaaatacattataacaactatttacttttttttttttctttttgagatggagtctcgctctgttgcccaggttggagtgcagtggcacgatctcggctcactgcaacctcacctcccgggttcaagagatcctcctgcctcagcctcctgagcagctgggactacaggcgcatgccaccatgcccagctaatttttgtatttttagtagaggcggggtttcaccatgttggccaggatggtctcaatctcctaaccttgagatccaccctccacagcctcccaaactgctgggattacaggcgtgagccaccgcacgtagcatttacattaggtattacaagtaatgtaaagatgatttaagtatacaggaggatgtgaataggttatatgcaagcactatgcccttttatataagtgacttgaacatctgtgcccgattttagtatgtgcaggggggcgatctgggaatcagtcccctgtggataccaaggtacaactgtatttattaacgcttactagatgtgaggagagtctgaatattttcagtgatcttggctgtttcaaaaaaatctattgacttttcaataaatcagctgcaatccatttatttcatttacaaaagatttattgtaagcctctcaatcttggtttttcagttgatcttaagcatgtcaattcataaaaacaagtcatttttgtatttttcatctttaagaatgcttaaaaaagctaatccctaaaatagttagatctttgtaaatgcatattaaataataaagtatgacccacattactttttatgggtgaaaataagacaaaaataatagttttagtgaggatggtgctgagtaaacataaaaactgatttgctctcagctgatgtgtcctgtacacagtgggaagattttagttcacacttagtctaactcccccattttacagatttctcactatatatatttctagaaggggctatgcatattcaatgtattgagaaccaaagcaaccacaaatgcataaatgcataatttatggtcttcaaccaaggccacataataacccagttaacttactctttaaccaggaatattaagttctataactagtactcaaggtttaaccttaaaattaagatttccttaaccttaaccttaaaattgatattatattaaacatacataatacaatgtaactccactgttctcctgaatattttttgctctaatctctctgccgaaagtcaaagtgatgggagaattggtatactggtatgactacgtcttaagtcagatttttatttatgagtctttgagactaaattcaatcaccaccaggtatcaaatcaacttttatgcagcaaatatatgattctagtgtctgacttttgttaaattcagtaatgcagtttttaaaaacctgtatctgacccactttgtaatttttgctccaatatccattctgtagacttttgaaaaaaaagtttttaatttgatgcccaatatattctgaccgttaaaaaattcttgttcatatgggagaagggggagtaatgacttgtacaaacagtatttctggtgtatattttaatgtttttaaaaagagtaatttcatttaaatatctgttattcaaatttgatgatgttaaatgtaatataatgtattttctttttattttgcactctgtaattgcactttttaagtttgaagagccattttggtaaacggtttttattaaagatgctatggaacataaagttgtattgcatgcaatttaaagtaacttatttgactatgaatattatcggattactgaattgtatcaatttgtttgtgttcaatatcagctttgataattgtgtaccttaagatattgaaggagaaaatagataatttacaagatattattaatttttatttatttttcttgggaattgaaaaaaattgaaataaataaaaatgcattgaacatcttgcattcaaaatcttcactgac

SEQ ID NO: 3 - DNA, 1270 bp, Homo sapiens
agacgttcgcacacctgggtgccagcgccccagaggtcccgggacagcccgaggcgccgcgcccgccgccccgagctccccaagccttcgagagcggcgcacactcccggtctccactcgctcttccaacacccgctcgttttggcggcagctcgtgtcccagagaccgagttgccccagagaccgagacgccgccgctgcgaaggaccaatgagagccccgctgctaccgccggcgccggtggtgctgtcgctcttgatactcggctcaggccattatgctgctggattggacctcaatgacacctactctgggaagcgtgaaccattttctggggaccacagtgctgatggatttgaggttacctcaagaagtgagatgtcttcagggagtgagatttcccctgtgagtgaaatgccttctagtagtgaaccgtcctcgggagccgactatgactactcagaagagtatgataacgaaccacaaatacctggctatattgtcgatgattcagtcagagttgaacaggtagttaagcccccccaaaacaagacggaaagtgaaaatacttcagataaacccaaaagaaagaaaaagggaggcaaaaatggaaaaaatagaagaaacagaaagaagaaaaatccatgtaatgcagaatttcaaaatttctgcattcacggagaatgcaaatatatagagcacctggaagcagtaacatgcaaatgtcagcaagaatatttcggtgaacggtgtggggaaaagtccatgaaaactcacagcatgattgacagtagtttatcaaaaattgcattagcagccatagctgcctttatgtctgctgtgatcctcacagctgttgctgttattacagtccagcttagaagacaatacgtcaggaaatatgaaggagaagctgaggaacgaaagaaacttcgacaagagaatggaaatgtacatgctatagcataactgaagataaaattacaggatatcacattggagtcactgccaagtcatagccataaatgatgagtcggtcctctttccagtggatcataagacaatggaccctttttgttatgatggttttaaactttcaattgtcactttttatgctatttctgtatataaaggtgcacgaaggtaaaaagtattttttcaagttgtaaataatttatttaatatttaatggaagtgtatttattttacagctcattaaacttttttaaccaaacagaaaaaaaaaaaaaaaaaaaaaaaaaaaaaaaaa

SEQ ID NO: 4 - DNA, 1487 bp, Homo sapiens
ctagcactctgacctagcagtcaacatgaaggctctcattgttctggggcttgtcctcctttctgttacggtccagggcaaggtctttgaaaggtgtgagttggccagaactctgaaaagattgggaatggatggctacaggggaatcagcctagcaaactggatgtgtttggccaaatgggagagtggttacaacacacgagctacaaactacaatgctggagacagaagcactgattatgggatatttcagatcaatagccgctactggtgtaatgatggcaaaaccccaggagcagttaatgcctgtcatttatcctgcagtgctttgctgcaagataacatcgctgatgctgtagcttgtgcaaagagggttgtccgtgatccacaaggcattagagcatgggtggcatggagaaatcgttgtcaaaacagagatgtccgtcagtatgttcaaggttgtggagtgtaactccagaattttccttcttcagctcattttgtctctctcacattaagggagtaggaattaagtgaaaggtcacactaccattatttccccttcaaacaaataatatttttacagaagcaggagcaaaatatggcctttcttctaagagatataatgttcactaatgtggttattttacattaagcctacaacatttttcagtttgcaaatagaactaatactggtgaaaatttacctaaaaccttggttatcaaatacatctccagtacattccgttcttttttttttttgagacagtctcgctctgtcgcccaggctggagtgcagtggcgcaatctcggctcactgcaacctccacctcccgggttcacgccattctcctgcctcagcctcccgagtagctgggattacgggcgcccgccaccacgcccggctaattttttgtatttttagtagagacagggtttcaccgtgttagccaggatggtctcgatctcctgaccttgtgatccacccacctcggcctcccaaagtgctgggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgatttcttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacac

SEQ ID NO: 5 - DNA, 983 bp, Homo sapiens
gtggaattcatggcatctacttcgtatgactattgcagagtgcccatggaagacggggataagcgctgtaagcttctgctggggataggaattctggtgctcctgatcatcgtgattctgggggtgcccttgattatcttcaccatcaaggccaacagcgaggcctgccgggacggccttcgggcagtgatggagtgtcgcaatgtcacccatctcctgcaacaagagctgaccgaggcccagaagggctttcaggatgtggaggcccaggccgccacctgcaaccacactgtgatggccctaatggcttccctggatgcagagaaggcccaaggacaaaagaaagtggaggagcttgagggagagatcactacattaaaccataagcttcaggacgcgtctgcagaggtggagcgactgagaagagaaaaccaggtcttaagcgtgagaatcgcggacaagaagtactaccccagctcccaggactccagctccgctgcggcgccccagctgctgattgtgctgctgggcctcagcgctctgctgcagtgagatcccaggaagctggcacatcttggaaggtccgtcctgctcggcttttcgcttgaacattcccttgatctcatcagttctgagcgggtcatggggcaacacggttagcggggagagcacggggtagccggagaagggcctctggagcaggtctggaggggccatggggcagtcctgggtgtggggacacagtcgggttgacccagggctgtctccctccagagcctccctccggacaatgagtcccccctcttgtctcccaccctgagattgggcatggggtgcggtgtggggggcatgtgctgcctgttgttatgggttttttttgcggggggggttgcttttttctggggtctttgagctccaaaaaataaacacttcctttgagggagagcaaaaaaaaaaaaaaaaaaaaaaaaaaaaaaaaaaaa

SEQ ID NO: 6 - DNA, 2842 bp, Homo sapiens
gagacgctcgctgtttgtatccattgaggagctgcctcgcgcagggggtgtgcgaggctgagtccaagagatagcaaatcgagtcttaaataatccggggagaaagacgcccgggtagatttgaggtgcagccttggagggagggattagaagccgctagactttttttcctcccctctcagtagcacggagtccgaattaattggatttcattcactggggaggaacaaaaactatctgggcagcttcattgagagagattcattgacactaagagccagcggctgcagctgggtgcagagagaacctccggctttacttctgtctcgtctgccccaaccgctagcctcggcttgggtaaggcgaggcggaattaaaccccgctccgagagcggcagcttcgcgcgcggtgcgctcggcctatgcctgccccgaggggcgtctggtaggcaccccgccctctcccgcagctcgacccccatgatagatacgctcagacccgtgcccttcgcgtcggaaatggcgatcagcaagacggtggcgtggctcaacgagcagctggagctgggcaacgagcggctgctgctgatggactgccggccgcaggagctatacgagtcgtcgcacatcgagtcggccatcaacgtggccatcccgggcatcatgctgcggcgcctgcagaagggtaacctgccggtgcgcgcgctcttcacgcgcggcgaggaccgggaccgcttcacccggcgctgtggcaccgacacagtggtgctctacgacgagagcagcagcgactggaacgagaatacgggcggcgagtcggtgctcgggctgctgctcaagaagctcaaggacgagggctgccgggcgttctacctggaaggtggcttcagtaagttccaagccgagttctccctgcattgcgagaccaatctagacggctcgtgtagcagcagctcgccgccgttgccagtgctggggctcgggggcctgcggatcagctctgactcttcctcggacatcgagtctgaccttgaccgagaccccaatagtgcaacagactcggatggtagtccgctgtccaacagccagccttccttcccagtggagatcttgcccttcctctacttgggctgtgccaaagactccaccaacttggacgtgttggaggaattcggcatcaagtacatcttgaacgtcacccccaatttgccgaatctctttgagaacgcaggagagtttaaatacaagcaaatccccatctcggatcactggagccaaaacctgtcccagtttttccctgaggccatttctttcatagatgaagcccggggcaagaactgtggtgtcttggtacattgcttggctggcattagccgctcagtcactgtgactgtggcttaccttatgcagaagctcaatctgtcgatgaacgatgcctatgacattgtcaaaatgaaaaaatccaacatatcccctaacttcaacttcatgggtcagctgctggacttcgagaggacgctgggactcagcagcccatgtgacaacagggttccagcacagcagctgtattttaccaccccttccaaccagaatgtataccaggtggactctctgcaatctacgtgaaagaccccacacccctccttgctggaatgtgtctggcccttcagcagtttctcttggcagcatcagctgggctgctttctttgtgtgtggccccaggtgtcaaaatgacaccagctgtctgtactagacaaggttaccaagtgcggaattggttaatactaacagagagatttgctccattctctttggaataacaggacatgctgtatagatacaggcagtaggtttgctctgtacccatgtgtacagcctacccatgcagggactgggattcgaggacttccaggcgcatagggtagaaccaaatgatagggtaggagcatgtgttctttagggccttgtaaggctgtttccttttgcatctggaactgactatataattgtcttcaatgaagactaattcaattttgcatatagaggagccaaagagagatttcagctctgtatttgtggtatcagtttggaaaaaaaaatctgatactccatttgattattgtaaatatttgatcttgaatcacttgacagtgtttgtttgaattgtgtttgttttttcctttgatgggcttaaaagaaattatccaaagggagaaagagcagtatgccacttcttaaaacagaacaaaacaaaaaaagaaaattgtgctcttttctaatccaaagggtatatttgcagcatgcttgactttaccaattctgatgacatctttacggacactattatcactaagaccttgttatggcgaagtctttagtctttttcatgtattttcctcatgattttttctctttatgtagtttgactatgccttacctttgtaaatatttttgcttgtgttgtcgcaaaggggataatctgggaaagacaccaaatcatgggctcactttaaaaaaagaaagaataaaaaaaccttcagctgtgctaaacagtatattacctctgtataaaattcttcagggagtgtcacctcaaatgcaatactttgggttggtttctttcctttaaaaaaatttgtataaaactggaagtgtgtgtgtgtgagcatgggtacccatttgataagagaaatgcatttgattgtgaagaagggagagttaaattctccattatgttcgtggtgtaaagtttagagctggaatttattataagaatgtaaaaccttaaattattaataaataactattttggctattgaaaaaaaaaaaaaaaaaaaaaaaa

SEQ ID NO: 7 - DNA, 4768 bp, Homo sapiens
atccttgccgcccgccccggcccagccgcgtcccggagccgtcgggcatggagccgtggaagcagtgcgcgcagtggctcatccattgcaaggtgctgcccaccaaccaccgggtgacctgggactcggctcaggtgttcgaccttgcgcagaccctccgcgatggagtcctgctctgccagctgcttaacaacctccgggcgcactccatcaacctgaaggagatcaacctgaggccgcagatgtcccagtttctctgtttgaagaacataaggacatttctcacggcctgttgtgagacgtttggaatgaggaaaagtgaacttttcgaggcatttgacttgtttgatgttcgtgactttggaaaggttatagaaacattatcacgactttctcgaacacctatagcattggccacaggaatcaggcccttcccaacagaagaaagcattaatgatgaagacatctacaaaggccttcctgatttaatagatgaaacccttgtggaagatgaagaagatctctatgactgtgtttatggggaagatgaaggtggagaagtctatgaggacttaatgaaggcagaggaagcacatcagcccaaatgtccagaaaatgatatacgaagttgttgtctagcagaaattaagcagacagaagaaaaatatacagaaactttggagtcaatagaaaagtatttcatggcaccactaaaaagatttctgacagcagcagaatttgattcagtattcatcaacattcctgaacttgtaaaacttcatcggaacctaatgcaagagattcatgattccattgtaaataaaaatgaccagaacttgtaccaagtttttattaactacaaggaaagattggttatttacgggcagtactgcagtggagtggagtcagccatctctagtttagactacatttctaagtcaaaagaagatgtcaaactgaaattagaggaatgttccaaaagagcaaataatgggaaatttactcttcgagacttgcttgtggttcctatgcaacgtgttttaaagtaccaccttctcctccaggaactggtcaaacataccactgatccgactgagaaggcaaatctgaaactggctcttgatgccatgaaggacttggcacaatatgtgaatgaagtgaaaagagataatgagacccttcgtgaaattaaacagtttcagctatctatagagaatttgaaccaaccagttttgctttttggacgacctcagggagatggtgaaattcgaataaccactctagacaagcataccaaacaagaaaggcatatcttcttatttgatttggcagtgatcgtatgtaagagaaaaggtgataactatgaaatgaaggaaataatagatcttcagcagtacaagatagccaataatcctacaaccgataaagaaaacaaaaagtggtcttatggcttctacctcatccatacccaaggacaaaatgggttagaattttattgcaaaacaaaagatttaaagaagaaatggctagaacagtttgaaatggctttgtctaacataagaccagactatgcagactccaatttccacgacttcaagatgcataccttcactcgagtcacatcctgcaaagtctgccagatgctcctgaggggaacattttatcaaggctatttatgttttaagtgtggagcgagagcacacaaagaatgtttgggaagagtagacaattgtggcagagttaattctggtgaacaagggacactcaaactaccagagaaacggaccaatggactgcgaagaactcctaaacaggtggatccaggtttaccaaagatgcaggtcattaggaactattctggaacaccacccccagctctgcatgaaggaccccctttacagctccaggccggggataccgttgaacttctgaaaggagatgcacacagtctgttttggcagggcagaaatttagcatctggagaggttggattttttccaagtgatgcagtcaagccttgcccatgtgtgcccaaaccagtagattattcttgccaaccctggtatgctggagcaatggaaagattgcaagcagagaccgaacttattaatagggtaaatagtacttaccttgtgaggcacaggaccaaagagtcaggagaatatgcaattagcattaagtacaataatgaagcaaagcacatcaagattttaacaagagatggcttttttcacattgcagaaaatagaaaatttaaaagtttaatggaacttgtggagtactacaagcatcattctctcaaggaagggttcagaaccttagatacaactctgcagtttccatacaaggagccagaacattcagctggacagaggggtaatagagcaggcaacagcttgttaagtccaaaagtgctgggcattgccatcgctcggtatgacttctgtgcaagagatatgagagagttgtccttgttgaaaggagatgtggtgaagatttacacaaagatgagtgcaaatggctggtggagaggagaagtaaatggcagggtgggctggtttccatccacatatgtggaagaggatgaataaattcaaatcccgtgttgcaccctgcaccaaaaatttcagagaagggataaatagaagcctgcacagcatcgtgaattaactgaagtgtttaaaaagctgcatttctggctgttcaacatcctccctccttagcccctcctaagtcttaatgctgagatttctaaagatgctggtactgacagattaatggcttgcctagagctgtgcaagaaacagcctgccagtctgtcattgtcagggaccagggcaaaaccaagagctgttcttcccagaagagccctgcaaacacattggttcgtgcttccctttacttcttctggtcagataccatgaatgccagtcatcagtaaatcttaatacacttttgctttattctcacatgccattcaccagattatttgatggtacaaagaagcagaagtgtaattttccttttcccagcatgacgaaaaattggagttctgccatttgagcagcttactggaaagatccagccttacttgtcttaaattgtccaacaaggtgactcattgcccggcaaacacttttaccctcagatgttactcatgatattataaaatatgaggccagtgctcaggtttgcatcataagtgagctatccctgaagggttttaattacttatttggtgtcctgattatatttgcaaacttctttataaaaggtgaaaaaagcacacaaaagagagggtgtcttcatattaaaccttcacaaccttcatgatttcataggattattttggaaatatagcacttgactttatgaaaggatctgggctaggtatattaggggtagttgccaataacctgaagaagctggcattgtttacagaaacagatcaagggctataatttatgtcattttatagcagcagtatctattaatacatgccttttcctcccatccacctcccccgcacacacacaaagatgacctgggacatgatttttttattcccacattttcttggagcacaaacaactttgttgaggattttggaaggaaagcacaactgggtcctttattcatttctgggacagaaagagggtcagtggacttttgtgggcctccagcttctctcagagtctccccctctgcagcccatcctgggagtgtattaactggagggaagatgggtcttgcagtacatttgttttgcccagccatcactcttttttgtgaggagcctaaatacattcttcctggggtccagagtccccattcaaggcagtcaagttaagacactaacttggccctttcctgatggaaatatttcctccatagcagaagttgtgttctgacaagactgagagagttacatgttgggaaaaaaaagaagcattaacttagtagaactgaaccaggagcattaagttctgaaattttgaatcatctctgaaatgaagcaggtgtagcctgccctctcatcaatccgtctgggtgccagaactcaaggttcagtggacacatccccctgttagagaccctcatgggctaggacttttcatctaggatagattcaagacctttacctcagaattatgtaaactgtgattgtgttttagaaaaattattatttgctaaaaccatttaagtctttgtatatgtgtaaatgatcacaaaaatgtattttataaaatgttctgtacaataaagttacacctcaaagtgtactcttggaatggattctttcctgtaaagtcttatctgcgactctgtctcgggaatgttttgtctgttgccgtcagccgaactttgttatggagggagcagcctcacacaagcagaaacactcctgtggatggtattgtagcatgtattgtttattttagtcaatagaccctctccttataaatggtgtttagtcttcctgttgcatttcatgggcctgggggtttcctagcagaggatattggagcccctttttgtgacattaccaattacatctttgtccacgtttaatactttgttttggaaaatttaaatgctgcagatttgtgtagagttctaataccaaagacagaagtaaatgttttccatatactttgtcttgcctgtatgcagcccttgtgtaatatggtgaattagagtggtatttcactttgtattattttgtaaatatgtcaatataataaatagtgactaaaaaaaaaaaaaa

SEQ ID NO: 8 - DNA, 4768 bp, Homo sapiens; identical to SEQ ID NO: 7

SEQ ID NO: 9 - DNA, 760 bp, Homo sapiens
gaggaaccgagaggctgagactaacccagaaacatccaattctcaaactgaagctcgcactctcgcctccagcatgaaagtctctgccgcccttctgtgcctgctgctcatagcagccaccttcattccccaagggctcgctcagccagatgcaatcaatgccccagtcacctgctgttataacttcaccaataggaagatctcagtgcagaggctcgcgagctatagaagaatcaccagcagcaagtgtcccaaagaagctgtgatcttcaagaccattgtggccaaggagatctgtgctgaccccaagcagaagtgggttcaggattccatggaccacctggacaagcaaacccaaactccgaagacttgaacactcactccacaacccaagaatctgcagctaacttattttcccctagctttccccagacaccctgttttattttattataatgaattttgtttgttgatgtgaaacattatgccttaagtaatgttaattcttatttaagttattgatgttttaagtttatctttcatggtactagtgttttttagatacagagacttggggaaattgcttttcctcttgaaccacagttctacccctgggatgttttgagggtctttgcaagaatcattaatacaaagaattttttttaacattccaatgcattgctaaaatattattgtggaaatgaatattttgtaactattacaccaaataaatatatttttgtacaaaaaaaaaaaaaaa

SEQ ID NO: 10 - DNA, 4999 bp, Homo sapiens
gaggaggattcgcagttcaacatcaaggtccctgtgcgttttattgcgacctgccggtgggaactttgtctccgagtcggagcagcatggagcggcggagcgagagcccgtgtctgcgggacagccccgaccggcggagcggcagcccggacgtcaaggggcctcccccagtgaaggtggcccggctggagcagaacggcagccccatgggagcccgcgggaggcccaacggcgccgtggccaaggccgtgggaggtttgatgattcctgtcttttgtgtcgtggagcagttggacggctctcttgaatatgacaacagagaagaacacgccgagtttgtcctggtgcggaaagatgtgctttttagccagctggtggagactgcgctcctggccctggggtattctcacagctctgcggcccaggcccaaggaataatcaagctgggaaggtggaaccctctccccctcagttatgtgacagatgcacccgacgcgacagtggccgacatgctacaagatgtctatcatgttgtgacgttgaaaatccaattacaaagttgttcaaagttggaagacttgcctgcggagcagtggaaccatgccacagtccgcaatgccttaaaggaactgctcaaagagatgaaccagagcacattagccaaagaatgccctctctcccagagtatgatttcatccattgtaaatagcacatattatgccaatgtgtcagcaaccaagtgccaggagtttgggagatggtataaaaagtacaagaagattaaagtggaaagagtggaacgagaaaacctttcagactattgtgttctgggccagcgtccaatgcatttaccaaatatgaaccagctggcatccctggggaaaaccaacgaacagtctcctcacagccaaattcaccacagtactccaatccgaaaccaagtgcccgcattacagcccatcatgagccctggtcttctttctccccagcttagtccacaacttgtaaggcaacaaatagccatggcccatctgataaaccaacagattgccgttagccggctcctggctcaccagcatcctcaagccatcaaccagcagttcctgaaccatccacccatccccagagcagttaagccagagccaaccaactcttccgtggaagtctctccagatatctaccagcaagtcagagatgagctgaagagggccagtgtgtcccaagctgtctttgcaagagtggcattcaaccgcacacagggattgttgtctgagattctgcgtaaggaagaagaccctcggacagcctctcagtctcttctagtaaacctgagggccatgcagaatttcctcaatctgccagaagtggagcgagatcgcatctaccaggatgagagggagcggagcatgaatcccaatgtgagcatggtctcctcggcctccagcagtcccagctcctcccgaacccctcaggccaaaacctcgacaccgacaacagacctccctattaaggtggacggcgccaacatcaacatcacagctgccatttatgacgagatccaacaggagatgaaaagggccaaggtgtctcaagccctgtttgccaaagtggctgcaaataaaagtcagggctggctgtgtgaactgctccgctggaaggagaacccaagcccagaaaaccgcaccctctgggaaaacctctgtaccatccgtcgcttcctgaaccttccccagcatgagagggatgtcatctatgaggaggagtcaaggcatcaccacagcgaacgcatgcaacacgtggtccagcttccccctgagccggtgcaggtacttcatagacagcagtctcagccagccaaggagagttcccctcccagagaagaagcgcctcccccacctcctccgactgaagacagttgtgccaaaaagccccggtctcgcacaaagatctccttagaagccctggggatcctccaaagctttattcatgatgtaggcctgtacccagaccaggaagccatccacactctttcggctcagctggatctccccaaacacaccatcatcaagttcttccagaaccagcggtaccacgtgaagcaccacgggaagctgaaagagcacctgggctccgcggtggacgtggctgaatataaggacgaggagctgctgaccgagtcagaggagaacgacagcgaggaaggctccgaggagatgtacaaagtggaggctgaggaggaaaatgctgacaaaagcaaggcagcacctgccgaaattgaccagagataatgtgaacttctactaggcaaagcaatacatcggtccaaggattttctgctttcatttctttaaaagttttttgttagtttgttttttgtttttgtttttgggtttttttggctttatttttgtctttttatgtctgttttgtttttcttacccttttggacatttctttgttgcacaggatacacctatagactgaataagttcagtatttccgaatcagacatcgccttggcaaagacactaaagcgttacactttatcccgtctctatgactggatcatagtcattataatcacaggagactctgccttcattatccttgcacttaacggaagttacatcaggcaagttccaggatgaaaagaactatgaaataaatgaaggaagctacaagtgtgtgtgtatatgtatatgtatatatctctatatttacatatatatattaaaattgcatgggacagagactttgcaatccgaaagaatagactgtgaaatgagttcttaaagaaaagacttgtttatgtattaaaaaaaccacttcacagtgagtcgctttggctttttgataaactgcggcctgctctcagggtggggtgactatttttgaattcctatttattttttgtgtttgtccctgatttttttttttaattctatggcttcctatctggcagcttaatgggtaatttttgaggtatgtatttaacaaaataaacgacactgccgaaaaaaaaaaaagtgaagtgaaaacaatcagggcacattaaaatgatacaagtcaaataaatcttaaagacacaatgcacacttaaaatgactcaataaaatgacttgctacgttccgttattcaatttgtcattactgtagtgaacagatgcatttctgtggaattccaaataagtaaaactgaaattcagtgcagagaaaactttgtccactagtgcaagtcttgatcaaatgacattttgacattggacatatggaattcatagtatgagccacattttgttgtgaaatttatttacctgcttgtggcttcaaatctgaaaattaataagcctgctcgtttaaaagttgtttgttgttgctgtttttttgtctttttgttttttactagaaaatagttcagtgtaatattaagttagaaaagaagttgctgcccagttaaaggggctccctctcaaataaatctccatccttccctctcccaaaagacatttctgatttctgcttcactttgggcttcctcttcttcgtacacattccatctacctaatcaaacattttcagtccctgatctctcctgtcccttttcctgggatgacagccctaacaagaactgtttttgaatcgttgtgcagctccaggcaatagagtatgtgaagcgatttcagtagaatcacttactcatcctaaaagaaaacattatcccagttacctacatcgcaattaccttatgtaaagcagaactaatgctgactggatgtttaatgggatgagcattaaagctgcaatctactatagtactccagatctctttcggcttcctatgagaaacaccagaagcattactttccacttctacttacagtaattgcaagaggagacctcacattcaggactggcctagtgaacgtaatccatgctttaaactggccattaaacagtcccacatggttggattttttttttttttttgagttgtgctttcacaaaaccttgtcaaagacctcatgcaatatcactttgaaagttattttctgtttactacacaaacattgtaatataactgttaatactatttatatatttgaaaggtataaaaggtaggagttaaaaaaaaaacctctatgtgtagatattaactcagaacttacaatatacagggagaagacatgttgcaatacaagctaattctagctgctcagtaacctctggagtttttaaagggacattttcctgtactttttcaaataatgatgtttaaaaattatcttgacataagcgtcatatacctttgcaaaaggatggttgtttgcagttagccctggccccatccttcctatttctgtagtatgctgcagctttaatcagaaagtccatggttgctgcttcctgatctccgagttactctttccaaattgtcttcttacactgttgctgaaggtcactctgtacacgtaatggaaactgattttgccaagctcttacaaggtggttcatctatcgatggcatccgcatttggtatcttttacacttcaaccaaaaatttattaggtatttttcaatgctaagtcttgccttttattttttaatttcactgccaagtttgcagtggttctaagtgaatctgtgggcattttagcctgtggtcttgccagatctttgcgaattacaatgcatatatgtctatttattcaatatctgtcatataatatctatttggaagaagaaactttctcttgtagtgcctcttgacaaagcacaatttcccgcctttttttttttttttgtgaaatgaaaaaaacaaattgtgttttattgcggtatcaacaatgtgaataaggattaacatattgtaaatgttcttttttccatgtaaatcaactatctttgttatcactaagtgataattaatttttaacttatgtgcattgttaggctgttagaattttttggttgttaaaataaacgcattcaataaatatg

SEQ ID NO: 11 - DNA, 6609 bp, Homo sapiens
ttcttttaaggagtttgccgcgagcgcgtctccttcattcgcaggctgggcgcgttcgcagtcggctggcggcgaaggaaggcgctctcgggacctcgcgggcgcgcgtcttttggctcttgcccctgtccctgcggcttggggaaggcgtaacccggcggctaggcgcgggagaagtgcggaggagccatgggcgccgggagctccaccgagcagcgcagcccggagcagccgcccgaggggagctccacgccggctgagcccgagcccagcggcggcggcccctcggccgaggcggcgccagacaccaccgcggaccccgccatcgctgcctcggaccccgccaccaagctcctacagaagaatggtcagctgtccaccatcaatggcgtagctgagcaagatgagctcagcctccaggagggtgacctaaatggccagaaaggagccctgaacggtcaaggagccctaaacagccaggaggaagaagaagtcattgtcacagaggttggacagagagactctgaagatgtgagcaaaagagactccgataaagagatggctactaagtcagcggttgttcacgacatcacagatgatgggcaggaggagacacccgaaataatcgaacagattccttcttcagaaagcaatttagaagagctaacacaacccactgagtcccaggctaatgatattggatttaagaaggtgtttaagtttgttggctttaaattcactgtgaaaaaggataagacagagaagcctgacactgtccagctactcactgtgaagaaagatgaaggggagggagcagcaggggctggcgaccacaaggaccccagccttggggctggagaagcagcatccaaagaaagcgaacccaaacaatctacagagaaacccgaagagaccctgaagcgtgagcaaagccacgcagaaatttctcccccagccgaatctggccaagcagtggaggaatgcaaagaggaaggagaagagaaacaagaaaaagaacctagcaagtctgcagaatctccgactagtcccgtgaccagtgaaacaggatcaaccttcaaaaaattcttcactcaaggttgggccggctggcgcaaaaagaccagtttcaggaagccgaaggaggatgaagtggaagcttcagagaagaaaaaggaacaagagccagaaaaagtagacacagaagaagacggaaaggcagaggttgcctccgagaaactgaccgcctccgagcaagcccacccacaggagccggcagaaagtgcccacgagccccggttatcagctgaatatgagaaagttgagctgccctcagaggagcaagtcagtggctcgcagggaccttctgaagagaaacctgctccgttggcgacagaagtgtttgatgagaaaatagaagtccaccaagaagaggttgtggccgaagtccacgtcagcaccgtggaggagagaaccgaagagcagaaaacggaggtggaagaaacagcagggtctgtgccagctgaagaattggttgaaatggatgcagaacctcaggaagctgaacctgccaaggagctggtgaagctcaaagaaacgtgtgtttccggagaggaccctacacagggagctgacctcagtcctgatgagaaggtgctgtccaaaccccccgaaggcgttgtgagtgaggtggaaatgctgtcatcacaggagagaatgaaggtgcagggaagtccactaaagaagctttttaccagcactggcttaaaaaagctttctggaaagaaacagaaagggaaaagaggaggaggagacgaggaatcaggggagcacactcaggttccagccgattctccggacagccaggaggagcaaaagggcgagagctctgcctcatcccctgaggagcccgaggagatcacgtgtctggaaaagggcttagccgaggtgcagcaggatggggaagctgaagaaggagctacttccgatggagagaaaaaaagagaaggtgtcactccctgggcatcattcaaaaagatggtgacgcccaagaagcgtgttagacggccttcggaaagtgataaagaagatgagctggacaaggtcaagagcgctaccttgtcttccaccgagagcacagcctctgaaatgcaagaagaaatgaaagggagcgtggaagagccaaagccggaagaaccaaagcgcaaggtggatacctcagtatcttgggaagctttaatttgtgtgggatcatccaagaaaagagcaaggagagggtcctcttctgatgaggaagggggaccaaaagcaatgggaggagaccaccagaaagctgatgaggccggaaaagacaaagagacggggacagacgggatccttgctggttcccaagaacatgatccagggcagggaagttcctccccggagcaagctggaagccctaccgaaggggagggcgtttccacctgggagtcatttaaaaggttagtcacgccaagaaaaaaatcaaagtccaagctggaagagaaaagcgaagactccatagctgggtctggtgtagaacattccactccagacactgaacccggtaaagaagaatcctgggtctcaatcaagaagtttattcctggacgaaggaagaaaaggccagatgggaaacaagaacaagcccctgttgaagacgcagggccaacaggggccaacgaagatgactctgatgtcccggccgtggtccctctgtctgagtatgatgctgtagaaagggagaaaatggaggcacagcaagcccaaaaaagcgcagagcagcccgagcagaaggcagccactgaggtgtccaaggagctcagcgagagtcaggttcatatgatggcagcagctgtcgctgacgggacgagggcagctaccattattgaagaaaggtctccttcttggatatctgcttcagtgacagaacctcttgaacaagtagaagctgaagccgcactgttaactgaggaggtattggaaagagaagtaattgcagaagaagaaccccccacggttactgaacctctgccagagaacagagaggcccggggcgacacggtcgttagtgaggcggaattgacccccgaagctgtgacagctgcagaaactgcagggccattgggtgccgaagaaggaaccgaagcatctgctgctgaagagaccacagaaatggtgtcagcagtctcccagttaaccgactccccagacaccacagaggaggccactccggtgcaggaggtggaaggtggcgtacctgacatagaagagcaagagaggcggactcaagaggtcctccaggcagtggcagaaaaagtgaaagaggaatcccagctgcctggcaccggtgggccagaagatgtgcttcagcctgtgcagagagcagaggcagaaagaccagaagagcaggctgaagcgtcgggtctgaagaaagagacggatgtagtgttgaaagtagatgctcaggaggcaaaaactgagccttttacacaagggaaggtggtggggcagaccaccccagaaagctttgaaaaagctcctcaagtcacagagagcatagagtccagtgagcttgtaaccacttgtcaagccgaaaccttagctggggtaaaatcacaggagatggtgatggaacaggctatcccccctgactcggtggaaacccctacagacagtgagactgatggaagcacccccgtagccgactttgacgcaccaggcacaacccagaaagacgagattgtggaaatccatgaggagaatgaggtcgcatctggtacccagtcagggggcacagaagcagaggcagttcctgcacagaaagagaggcctccagcaccttccagttttgtgttccaggaagaaactaaagaacaatcaaagatggaagacactctagagcatacagataaagaggtgtcagtggaaactgtatccattctgtcaaagactgaggggactcaagaggctgaccagtatgctgatgagaaaaccaaagacgtaccatttttcgaaggacttgaggggtctatagacacaggcataacagtcagtcgggaaaaggtcactgaagttgcccttaaaggtgaagggacagaagaagctgaatgtaaaaaggatgatgctcttgaactgcagagtcacgctaagtctcctccatcccccgtggagagagagatggtagttcaagtcgaaagggagaaaacagaagcagagccaacccatgtgaatgaagagaagcttgagcacgaaacagctgttaccgtatctgaagaggtcagtaagcagctcctccagacagtgaatgtgcccatcatagatggggcaaaggaagtcagcagtttggaaggaagccctcctccctgcctaggtcaagaggaggcagtatgcaccaaaattcaagttcagagctctgaggcatcattcactctaacagcggctgcagaggaggaaaaggtcttaggagaaactgccaacattttagaaacaggtgaaacgttggagcctgcaggtgcacatttagttctggaagagaaatcctctgaaaaaaatgaagactttgccgctcatccaggggaagatgctgtgcccacagggcccgactgtcaggcaaaatcgacaccagtgatagtatctgctactaccaagaaaggcttaagttccgacctggaaggagagaaaaccacatcactgaagtggaagtcagatgaagtcgatgagcaggttgcttgccaggaggtcaaagtgagtgtagcaattgaggatttagagcctgaaaatgggattttggaacttgagaccaaaagcagtaaacttgtccaaaacatcatccagacagccgttgaccagtttgtacgtacagaagaaacagccaccgaaatgttgacgtctgagttacagacacaagctcacgtgataaaagctgacagccaggacgctggacaggaaacggagaaagaaggagaggaacctcaggcctctgcacaggatgaaacaccaattacttcagccaaagaggagtcagagtcaaccgcagtgggacaagcacattctgatatttccaaagacatgagtgaagcctcagaaaagaccatgactgttgaggtagaaggttccactgtaaatgatcagcagctggaagaggtcgtcctcccatctgaggaagagggaggtggagctggaacaaagtctgtgccagaagatgatggtcatgccttgttagcagaaagaatagagaagtcactagttgaaccgaaagaagatgaaaaaggtgatgatgttgatgaccctgaaaaccagaactcagccctggctgatactgatgcctcaggaggcttaaccaaagagtccccagatacaaatggaccaaaacaaaaagagaaggaggatgcccaggaagtagaattgcaggaaggaaaagtgcacagtgaatcagataaagcgatcacaccccaagcacaggaggagttacagaaacaagagagagaatctgcaaagtcagaacttacagaatcttaaaacatcatgcagttaaactcattgtctgtttggaagaccagaatgtgaagacaagtagtagaagaaaatgaatgctgctgctgagactgaagaccagtatttcagaactttgagaattggagagcaggcacatcaactgatctcatttctagagagcccctgacaatcctgaggcttcatcaggagctagagccatttaacatttcctctttccaagaccaacctacaattttcccttgataaccatataaattctgatttaaggtcctaaattcttaacctggaactggagttggcaatacctagttctgcttctgaaactggagtatcattctttacatatttatatgtatgttttaagtagtcctcctgtatctattgtatatttttttcttaatgtttaaggaaatgtgcaggatactacatgctttttgtatcacacagtatatgatggggcatgtgccatagtgcaggcttggggagctttaagcctcagttatataacccacgaaaaacagagcctcctagatgtaacattcctgatcaaggtacaattctttaaaattcactaatgattgaggtccatatttagtggtactctgaaattggtcactttcctattacacggagtgtgctaaaactaaaaagcattttgaaacatacagaatgttctattgtcattgggaaatttttctttctaacccagtggaggttagaaagaagttatattctggtagcaaattaactttacatcctttttcctacttgttatggttgtttggaccgataagtgtgcttaatcctgaggcaaagtagtgaatatgttttatatgttatgaagaaaagaattgttgtaagtttttgattctactcttatatgctggactgcattcacacatggcatgaaataagtcaggttctttacaaatggtattttgatagatactggattgtgtttgtgccatatttgtgccattcttttaagaacaatgttgcaacacattcatttggataagttgtgatttgacgactgatttaaataaaatatttgcttcacttaaaaaaaaaaaa

SEQ ID NO: 12 - DNA, 2128 bp, Homo sapiens
cttgagaatgtttctgcatgatttctctgggcttgctgtcttacctgagagcaggaagtcaaaaggagagtgatggagccacctgctgccctctactttgcagatattaaagaggagcctgaaactgttccttggacatcttatgaatgtcagaaaataccttttggagggttagaagatcaggggacatggttgttcacatttgctgccacggaacaccgccagtcttcacttggaaacagaatcacgccttgtgaagagatcatccctaagcaggagagaagctactaaaggattgtgtcctcctccaccttccctgtgctcggtctccacctgtctcccattctgtgacgatggttcaatggaagagactctgccagctgcattacttgtgggctctgggctgctatatgctgctggccactgtggctctgaaactttctttcaggttgaagtgtgactctgaccacttgggtctggagtccagggaatctcaaagccagtactgtaggaatatcttgtataatttcctgaaacttccagcaaagaggtctatcaactgttcaggggtcacccgaggggaccaagaggcagtgcttcaggctattctgaataacctggaggtcaagaagaagcgagagcctttcacagacacccactacctctccctcaccagagactgtgagcacttcaaggctgaaaggaagttcatacagttcccactgagcaaagaagaggtggagttccctattgcatactctatggtgattcatgagaagattgaaaactttgaaaggctactgcgagctgtgtatgcccctcagaacatatactgtgtccatgtggatgagaagtccccagaaactttcaaagaggcggtcaaagcaattatttcttgcttcccaaatgtcttcatagccagtaagctggttcgggtggtttatgcctcctggtccagggtgcaagctgacctcaactgcatggaagacttgctccagagctcagtgccgtggaaatacttcctgaatacatgtgggacggactttcctataaagagcaatgcagagatggtccaggctctcaagatgttgaatgggaggaatagcatggagtcagaggtacctcctaagcacaaagaaacccgctggaaatatcactttgaggtagtgagagacacattacacctaaccaacaagaagaaggatcctcccccttataatttaactatgtttacagggaatgcgtacattgtggcttcccgagatttcgtccaacatgttttgaagaaccctaaatcccaacaactgattgaatgggtaaaagacacttatagcccagatgaacacctctgggccacccttcagcgtgcacggtggatgcctggctctgttcccaaccaccccaagtacgacatctcagacatgacttctattgccaggctggtcaagtggcagggtcatgagggagacatcgataagggtgctccttatgctccctgctctggaatccaccagcgggctatctgcgtttatggggctggggacttgaattggatgcttcaaaaccatcacctgttggccaacaagtttgacccaaaggtagatgataatgctcttcagtgcttagaagaatacctacgttataaggccatctatgggactgaactttgagacacactatgagagcgttgctacctgtggggcaagagcatgtacaaacatgctcagaacttgctgggacagtgtgggtgggagaccagggctttgcaattcgtggcatcctttaggataagagggctgctattagattgtgggtaagtagatcttttgccttgcaaattgctgcctgggtgaatgctgcttgttctctcacccctaaccctagtagttcctccactaactttctcactaagtgagaatgagaactgctgtgatagggagagtgaaggagggatatgtggtagagcacttgatttcagttgaatgcctgctggtagcttttccattctgtggagctgccgttcctaataattccaggtttggtaacgtggaggagaactttgatggaaagagaacttccttctgtactgttaacttaaaaataaatactcctgatcaaaaaaaaaaaa

SEQ ID NO: 13 - DNA, 5228 bp, Homo sapiens
actgcagctgcagcccccgaggtcgccgcagtaatccggacccggcagcacccgcaccctcggcggccgcagcctcagcaccgcagagcggagagcggagcccggagcccgccgccccaggatggctgcagctcctccaagttactgttttgttgccttccctccacgtgctaaggatggtctggtggtatttgggaaaaattcagcccggcccagagatgaagtgcaagaggttgtgtatttctcggctgctgatcacgaaccggagagcaaggttgagtgcacttacatttcaatcgaccaagttccaaggacctatgccataatgataagcagacccgcctggctctggggagcagaaatgggagccaatgaacatggagtgtgcatagccaatgaagccatcaacaccagagagccagctgccgagatagaagccttgctggggatggatctggtcaggcttggtttagaaagaggggaaacagctaaagaagccttagatgtcattgtctccttgttggaagaacatggacaaggtgggaattactttgaagatgcaaactcctgccacagcttccaaagtgcatatctgattgtggatcgtgatgaagcctgggtgctcgagaccatagggaagtactgggctgccgagaaagtcacagagggagtgaggtgcatttgcagtcagctttcgctcaccactaagatggatgcagagcatccggaactcaggagttacgctcagagccaaggttggtggacgggagagggcgagttcaatttttccgaagtcttttctccagttgaggatcatctagactgcggtgctggcaaagacagcttagaaaaacaagaagaaagcatcacagtgcagactatgatgaacaccttacgggacaaagccagcggagtgtgcatagactctgagtttttcctcaccacagccagtggagtgtctgtcctgccgcagaatagaagctctccgtgcattcactacttcactggaacccatgatccttccaggtccatattcaagcctttcatctttgttgatgacgtaaaacttgtccccaaaacacagtctccctgttttggggatgacgaccctgccaaaaaggagcctcggttccaggagaaaccagaccgccggcatgagctgtacaaagcccacgagtgggcacgtgccatcatcgaaagtgaccaggagcaaggtcgcaagctgaggagcaccatgctggagctggagaagcaaggcctggaagccatggaagaaatcctgaccagctccgagccactggaccctgcggaagtgggggaccttttctatgactgtgttgacacggagattaagttctttaagtgaagtaagcattccctttccccttcttatttaagacttcccaccttactaaattaccagcaaaacaaaccactctcctgtttgagtaaaatgagaaagttaatatgtggcctccttttctgaagccagatcaaactgttaccttgtgttccaccttgaatctcacagcgtccccttctgcaatgtaggtctccttcctgtgcagtgtaacatgtatcccgttgcctgttgttcggttgtgtgactaattgtggattttaagctgctattattgtatttcagtggcaatggacacattagccttttacaagaggactagagttcatcaagccttgaaaggcaggcttcacagtgccgagttggcgggaaaagcaaattcttttgaagtcttagtctttccctcagtagcggtttctttcaggttaacaagaggcatttgtgcacacacacagggctcttgggtgtgttgtcaaggggaccctccgtggcctcctgtgagtgcatgcctgtagtgcacagtgtctctacaggtgtcttctggggggcagaaccaattggaaggaagaaagggacccctctccagtcctggctccttcctacatcctgggctcctgaagaagctgtcttcccattttccatgcactgtgcttatgtgtggtggactgcagagctgcttccacttacaggagagctgataatttgttagctggaacctattcacttccgagattcagacatagccatgctggtggccttctgaatcactgcatggatgtcccaggaggcagctctccccacacagcagcacagccatcacaggattccttgtgtagaaatgattcccagtctagttaccaacagctagtctaggagtaattgaatggccctatggcacagttccacccacagagtggtgaatctctcagccaaggagggaaagaaaaggaagaactcttgactatttagattctagttaaatatctggaatcttagcagtcactacattatctcagcagagagactttaattaaactgatttgtttccaatgtcgggttcacttaaaggatttgacttaccaccagagcatagaaaagcatgcaaggaagaccagatgggcttagcattgggaagacagagggcaaggaggcgatagatggatatagaagcatttctctgcaggataccagttcaggccccaccattcctgccaaggccattacatcccacaaacccaaatacaaagcagctgacttccctggatcttccccccactcctcacacctcacatgtccgaggagctgccttcattcaggcgggtagctgcactgggcatggggtggtggtgggagcttaccgccacctattcaagctctcagctactcctgaaacgggcagagatgatgaacagaagtgtatgtaaatacagcagctagtgggagagcaccagttgggcctaatcctgcctcatcattcttggcaggaatctgcaaatggaaacattgtgagtatcagcaatctgggaagtgacagggttaataactccttcccagaagctgtatcatgagattttgaggggaccgagccctgttacatggatgtgaacagtgaggatcagaggttttatcagaacacattatttttttctaccaactctccagagcgtgagtataggagtgccatgagctttttactcagcagttttgtaaactctgtatataaaatcattaaccacacattgtgggtgatgggaagacgatttcagctgacagagttaatggcaaccaataatggtggcctgtagctgctaagagcttcacgcaggtttggcctgggctttcactgttggtgaatttagagtgtccttttaggtggggcggctattctaaaagtgtctttctatcactgttaaggggggcggaaagtgaggttcgaggatgacgtaggtaactctcccctcccaagtccatgttccaagtggctatgtaaagcaagatgatacagaaagctgctctaaaatctcactgagtgatttcaccttcgcctactatgaaatgtctcatcagacctgacatgtctgagataaccaaggtgattcaggatttgatcaaaagaagtctagtaagaattaattacacagaagcctcctttcatttctatgggccaaacaaaggccatggataaccctacccgctttatgtcattacccattgggaaacacaatggctacttctgttagggtacattgaccttggtcaagcatcttaaagaaggcaaccctaattgagagctgtcttggctaatactctgcaccacaattgtgatgtcctagtcctaccactagagggcatggtacagcctggcaaaagttaaaaggggtgtggcagctcccatcaggtctggaggtggtctataagcacagttgacagttgtgcattgggatgggtggagaaagacgacaagagagcagagaatctgctgatgtggctgcgcttacttttagtgactttatgtacttatattaacagctggaaataggttgttgggttttgagcaggctgttatagtgaggaatgttcatttttaaatgttcctaacagattttgcttttgaaaaatgcttgttacatgaataatttgtggaccagggattgcttttctgaaggcagtatagggaacatgaatattcaagatgaaatacaaaaattatgtttaagggtcatagtgtataagtagcttcctaggaaaccatttgtgtatcttttctgactgggatgggggctgagcatgcttgtgcagaaagaagccatagcaagaaaggacagaatctctcccccactcccttgccccataaccaaacataagctagctagtcttgtctaatagatgggatttactataggtgaagatagccatcatattcaaggacagaagctctggcaggagtaaattagcaaagcagaaatagtaccctttcattcttagaggtgctttgaaattttaggtagaatataatcgaaattatggaggttccttagtgctcaataatataagacctgttgttattagaacgagtctttcttataaactaacagagcaggtatatgcctgttagatcttagctgtggggttcctttactattgggtgaatcattaggtataaaaaataatcatcaaccaggcaaattactttgcttcctagctgatgtcatcccacattggtacaggtgttattcagtactgggtggttcagcagggaagccaggtgggaccagtgtgtctgtcatgaaaccactaactgcattcctgactgaagagccatctgtcatttattggggaaggtcttcagttgagctctcagccttagtaaggaagcacgtggaggagggacggaggaggttcccttgctgggcatgcttcgtagagggccaggagcagcaggtcatgtgcacatgccgttgcagcacaagcttatgcttcccgtagccgtggcttttcattctgcacagtcccaggtcccagctcccctcttatggtttctgtcataatgtgctttatctgattgactccaaacatcccgaaatgtcacctgcagatttctcgtgggaaccaatatgtacatgtttgcaattatgctgtgagaatttaaatgtgttagatggaaaatgctattggcagggaataataataaaaaaaaaagaaaatcattctgtttcctgcagtgggaactggccatgtagtcttaacagtcttttgtacaaatatctacaaagcagataatatccctatccagtgcttgcccttggaattgtctctaaatgcatcaagcatacaataaaaaaaactgaaatcaaaaaaaaaaaaaaaa

SEQ ID NO: 14 - DNA, 4093 bp, Homo sapiens
cgcgcgctgcctgaggacgccgcggcccccgcccccgccatgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaacggcagcaaggtgggcccggacggcacaccctacgttaccgtgctcaagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacaaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagccctccctgctgctggtgcacagccactccccggcatgagactcagtgcagatggagagacagctacacagagctttggtctgtgtgtgtgtgtgtgcgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggaccccgtggggcagggagctgggcccgacatggctcggcctctgcctttgcaccacgggacatcacagggtgcgctcggcccctcccacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccaggggtctcacccatgcaagcagaggaccagggctttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttgctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaacctgaaaaaaaaaaaaaaaaaaaaaaaaaaaaaa

SEQ ID NO: 15 - DNA, 587 bp, Homo sapiens
taaatcttttctgcttactgaaaaggaagagtctgatgattagttactgatcctctttgcatttgtaaagctttggagatattgaatcatgttaccatttctgtttttttccaccctgttttcttccatatttactgaagctcagaagcagtattgggtctgcaactcatccgatgcaagtatttcatacacctactgtgataaaatgcaatacccaatttcaattaatgttaacccctgtatagaattgaaaggatccaaaggattattgcacattttctacattccaaggagagatttaaagcaattatatttcaatctctatataactgtcaacaccatgaatcttccaaagcgcaaagaagttatttgccgaggatctgatgacgattactctttttgcagagctctgaagggagagactgtgaatacaacaatatcattctccttcaagggaataaaattttctaagggaaaatacaaatgtgttgttgaagctatttctgggagcccagaagaaatgctcttttgcttggagtttgtcatcctacaccaacctaattcaaattagaataaattgagtattt

SEQ ID NO: 16 - DNA, 1431 bp, Homo sapiens
gctgttcgcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggagcagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcctgcgtctg

SEQ ID NO: 17 - DNA, 2709 bp, Homo sapiens
gcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacacttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagataaagaaaaaaacaaacccgagaaacaatgaccccaagagcatgaagctaccccaggaacagagtcagcttccaaatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtgaaaaaaaaaaaaaaa

SEQ ID NO: 18 - DNA, 1938 bp, Homo sapiens
gactttggtggcaagaggagctggcggagcccagccagtgggcggggccaggggaggggcgggcaggtaggtgcagccactcctgggaggaccctgcgtggccagacggtgctggtgactcgtccacactgctcgcttcggatactccaggcgtctcccgttgcggccgctccctgccttagaggccagccttggacacttgctgcccctttccagcccggattctgggatccttccctctgagccaacatctgggtcctgccttcgacaccaccccaaggcttcctaccttgcgtgcctggagtctgccccaggggcccttgtcctgggccatggcccagaagggggtcctggggcctgggcagctgggggctgtggccattctgctctatcttggattactccggtcggggacaggagcggaaggggcagaagctccctgcggtgtggccccccaagcacgcatcacaggtggcagcagtgcagtcgccggtcagtggccctggcaggtcagcatcacctatgaaggcgtccatgtgtgtggtggctctctcgtgtctgagcagtgggtgctgtcagctgctcactgcttccccagcgagcaccacaaggaagcctatgaggtcaagctgggggcccaccagctagactcctactccgaggacgccaaggtcagcaccctgaaggacatcatcccccaccccagctacctccaggagggctcccagggcgacattgcactcctccaactcagcagacccatcaccttctcccgctacatccggcccatctgcctccctgcagccaacgcctccttccccaacggcctccactgcactgtcactggctggggtcatgtggccccctcagtgagcctcctgacgcccaagccactgcagcaactcgaggtgcctctgatcagtcgtgagacgtgtaactgcctgtacaacatcgacgccaagcctgaggagccgcactttgtccaagaggacatggtgtgtgctggctatgtggaggggggcaaggacgcctgccagggtgactctgggggcccactctcctgccctgtggagggtctctggtacctgacgggcattgtgagctggggagatgcctgtggggcccgcaacaggcctggtgtgtacactctggcctccagctatgcctcctggatccaaagcaaggtgacagaactccagcctcgtgtggtgccccaaacccaggagtcccagcccgacagcaacctctgtggcagccacctggccttcagctctgccccagcccagggcttgctgaggcccatccttttcctgcctctgggcctggctctgggcctcctctccccatggctcagcgagcactgagctggccctacttccaggatggatgcatcacactcaaggacaggagcctggtccttccctgatggcctttggacccagggcctgacttgagccactccttccttcaggactctgcgggaggctggggccccatcttgatctttgagcccattcttctgggtgtgctttttgggaccatcactgagagtcaggagttttactgcctgtagcaatggccagagcctctggcccctcacccaccatggaccagcccattggccgagctcctggggagctcctgggacccttggctatgaaaatgagccctggctcccacctgtttctggaagactgctcccggcccgcctgcccagactgatgagcacatctctctgccctctccctgtgttctgggctggggccacctttgtgcagcttcgaggacaggaaaggccccaatcttgcccactggccgctgagcgcccccgagccctgactcctggactccggaggactgagcccccaccggaactgggctggcgcttggatctggggtgggagtaacagggcagaaatgattaaaatgtttgagcac

SEQ ID NO: 19 - DNA, 1484 bp, Homo sapiens
cccgtgaggaggaaaaggtgtgtccgctgccacccagtgtgagcgggtgacaccacccggttaggaaatcccagctcccaagagggtataaatccctgctttactgctgagctcctgctggaggtgaaagtctggcctggcagccttccccaggtgagcagcaacaaggccacgtgctgctgggtctcagtcctccacttcccgtgtcctctggaagttgtcaggagcaatgttgcgcttgtacgtgttggtaatgggagtttctgccttcacccttcagcctgcggcacacacaggggctgccagaagctgccggtttcgtgggaggcattacaagcgggagttcaggctggaaggggagcctgtagccctgaggtgcccccaggtgccctactggttgtgggcctctgtcagcccccgcatcaacctgacatggcataaaaatgactctgctaggacggtcccaggagaagaagagacacggatgtgggcccaggacggtgctctgtggcttctgccagccttgcaggaggactctggcacctacgtctgcactactagaaatgcttcttactgtgacaaaatgtccattgagctcagagtttttgagaatacagatgctttcctgccgttcatctcatacccgcaaattttaaccttgtcaacctctggggtattagtatgccctgacctgagtgaattcacccgtgacaaaactgacgtgaagattcaatggtacaaggattctcttcttttggataaagacaatgagaaatttctaagtgtgagggggaccactcacttactcgtacacgatgtggccctggaagatgctggctattaccgctgtgtcctgacatttgcccatgaaggccagcaatacaacatcactaggagtattgagctacgcatcaagaaaaaaaaagaagagaccattcctgtgatcatttcccccctcaagaccatatcagcttctctggggtcaagactgacaatcccgtgtaaggtgtttctgggaaccggcacacccttaaccaccatgctgtggtggacggccaatgacacccacatagagagcgcctacccgggaggccgcgtgaccgaggggccacgccaggaatattcagaaaataatgagaactacattgaagtgccattgatttttgatcctgtcacaagagaggatttgcacatggattttaaatgtgttgtccataataccctgagttttcagacactacgcaccacagtcaaggaagcctcctccacgttctcctggggcattgtgctggccccactttcactggccttcttggttttggggggaatatggatgcacagacggtgcaaacacagaactggaaaagcagatggtctgactgtgctatggcctcatcatcaagactttcaatcctatcccaagtgaaataaatggaatgaaataattcaaacacaaaaaaaaaaaaaaaaaaaaaaaaaaaaaa

SEQ ID NO: 20 - DNA, 3641 bp, Homo sapiens
ctgcactgaagagggagagcgagagagagactggagacgcacagatccccccaaggtctcccaagcctaccgtcccacagattattgtacagagccccaaaaatcgaaacagaggaaacgaacagcagttgaacatggacgaaggaattcctcatttgcaagagagacagttactggaacatagagattttataggactggactattcctctttgtatatgtgtaaacccaaaaggagcatgaaacgagacgacaccaaggatacctacaaattaccgcacagattaatagaaaagaaaagaagagaccgaattaatgaatgcattgctcagctgaaagatttactgcctgaacatctgaaattgacaactctgggacatctggagaaagctgtagtcttggaattaactttgaaacacttaaaagctttaaccgccttaaccgagcaacagcatcagaagataattgctttacagaatggggagcgatctctgaaatcgcccattcagtccgacttggatgcgttccactcgggatttcaaacatgcgccaaagaagtcttgcaatacctctcccggtttgagagctggacacccagggagccgcggtgtgtccagctgatcaaccacttgcacgccgtggccacccagttcttgcccaccccgcagctgttgactcaacaggtccctctgagcaaaggcaccggcgctccctcggccgccgggtccgcggccgccccctgcctggagcgcgcggggcagaagctggagcccctcgcctactgcgtgcccgtcatccagcggactcagcccagcgccgagctcgccgccgagaacgacacggacaccgacagcggctacggcggcgaagccgaggcccggccggaccgcgagaaaggcaaaggcgcgggggcgagccgcgtcaccatcaagcaggagcctcccggggaggactcgccggcgcccaagaggatgaagctggattcccgcggcggcggcagcggcggcggcccggggggcggcgcggcggcggcggcagccgcgcttctggggcccgaccctgccgccgcggccgcgctgctgagacccgacgccgccctgctcagctcgctggtggcgttcggcggaggcggaggcgcgcccttcccgcagcccgcggccgccgcggcccccttctgcctgcccttctgcttcctctcgccttctgcagctgccgcctacgtgcagcccttcctggacaagagcggcctggagaagtatctgtacccggcggcggctgccgccccgttcccgctgctataccccggcatccccgccccggcggcagccgcggcagccgccgccgccgctgccgccgccgccgccgcgttcccctgcctgtcctcggtgttgtcgccccctcccgagaaggcgggcgccgccgccgcgaccctcctgccgcacgaggtggcgccccttggggcgccgcacccccagcacccgcacggccgcacccacctgcccttcgccgggccccgcgagccggggaacccggagagctctgctcaggaagatccctcgcagccaggaaaggaagctccctgaatccttgcgtcccgaaggacggaggttcaagcagagtgagaagttaaaatacccttaaggaggttcaagcagagtgagaagttaaaatacccttaaggtctttaagggaggaagtgtaatagatgcacgacaggcataaacaagaacaacaaaacaggtgttatgtgtacattcggagttcctgttttgctcatcccgcaccaccccaccctccacacactaacatccctttcttccccccaccagctgtaaaagatcctatgcgaaagacactggctcttttttttaatcccccaaataaattttgcccccttttaggccatgttccattatctcttaaaattggaacctaattcgagaggaagtaagaagggtctgttctgtggctgagctaggtgaaccccggggtaggggaaagatgttaacacctttgacgtctttggagttgacatggaacagcaggtagttgttatgtagagctagttctcaaagctgccctgcctgttttaggaggcgttccacaaacagattgaggctctttttagaattgaatttactcttcagtattttctaatgttcagctttctaaaaggcatatatttttcaaagaagtgaggatgcagtttctcacgttgcaacctattctgaagtggtttaaatggtatctcttagtaacttgcactcgttaaagaaacacggagctgggccatcgtcagaactaagtcagggaaggagatggatgagaaggccagaatcattcctagtacatttgctaacactttattgagaaattgaccatgaattaatggactcatcttaatttcttctaagtccatatatagatagatatctatctgtacagatttctatttatccatagataggtatctatacatacacatctcaagtgcatctattcccactctcattaatccatcatgttcctaaatttttgtaatcttactgtaaaaaaaagtgcactgaacttcaaaacaaaacaaaaaacaacaacaacaaaaaacaagtccaaactgatatatcctatattctgttaaaattcaaaagtgaacgaaagcatttaactggccagttttgattgcaaatgctgtaaagatatagaatgaagtcctgtgaggccttcctatctccaagtctatgtattttctggagaccaaaccagataccagataatcacaaagaaagcttttttaataaggcttaaaccaagaccttgtctagatatttttagtttgttgccaaggtagcactgtgagaaatctcacttggatgttatgtaaggggtgagacacaacagtctgactatgagtgaggaaaatatctgggtcttttcgtcagtttggtgcatttgctgctgctgttgctactgtttgcctcaaacgctgtgtttaaacaacgttaaactcttagcctacaaggtggctcttatgtacatagttgttaatacatccaattaatgatgtctgacatgctatttttgtagggagaaaatatgtgctaatgatattttgagttaaaatatcttttggggaggatttgctgaaaagttgcacttttgttacaatgcttatgcttggtacaagcttatgctgtcttaaattattttaaaaaaattaaatactgtctgtgagaaaccagctggtttagaaaagtttagtatgtgacgataaactagaaattacctttatattctagtattttcagcactccataaattctattacctaaatattgccacactattttgtgatttaaaaattcttactaaggaataaaaactttaatatacgatatgatattgtctaataattaaaaaagacataatggatgctcaattagttttaagatatctataactatagggatacaaatcactacagttctcagatttacaccttttttttgtcattggcttgatgtcacacatttccaatctcttgcaagcctccaggctctggctttgtctacctgctcgttcccaatgtatcttaatgaaaagtgcaaaagaaaaacctaccaattaaaaaaaaaaaaaaaaaa

SEQ ID NO: 21 - DNA, 1201 bp, Homo sapiens
atagttctccctgattgagacttgcctgctgctgtgaccactggtcttgtcctcttctccagcatggtgtgtctgaagctccctggaggctcctgtatggcagcgctgacagtgacattgacggtgctgagctccccactggctttggctggggacacccaaccacgtttcttggagcaggctaagtgtgagtgtcatttcctcaatgggacggagcgagtgtggaacctgatcagatacatctataaccaagaggagtacgcgcgctacaacagtgacctgggggagtaccaggcggtgacggagctggggcggcctgacgctgagtactggaacagccagaaggacctcctggagcggaggcgggccgaggtggacacctactgcagatacaactacggggttgtggagagcttcacagtgcagcggcgagtccaacctaaggtgactgtgtatccttcaaagacccagcccctgcagcaccacaacctcctggtctgctctgtgaatggtttctatccaggcagcattgaagtcaggtggttccggaacggccaggaagagaaggctggggtggtgtccacaggcctgatccagaatggagactggaccttccagaccctggtgatgctggaaacagttcctcggagtggagaggtttacacctgccaagtggagcatccaagcatgatgagccctctcacggtgcaatggagtgcacggtctgaatctgcacagagcaagatgctgagtggagtcgggggctttgtgctgggcctgctcttccttgggacagggctgttcatctacttcaggaatcagaaaggacactctggacttcagccaacaggactcttgagctgaagtgcagatgaccacattcaaggaagaaccttctgccccagctttgcaagatgaaaagctttcccacttggctcttattcttccacaagagctttgtcaggaccaggttgttactggttcagcaactctgcagaaaatgtcctcccttgtggcttccttagctcctgttcttggcctgaagcctcacagctttgatggcagtgcctcatcttcaacttttgtgcttccctttacctaaactgtcctgcctcccgtgcatctgtactccccttgtgccacacattgcattattaaatgtttctcaaacaaaaaaaaaaaaaaaaaaaaaaaaaaaaaa

SEQ ID NO: 22 - DNA, 3806 bp, Homo sapiens
gaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacttgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggagaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctgtctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggaccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacaggtcgctcatcccgtcagtcatcctttattgcagtcgggatccttggggttgttctgttggccattttcgtcgcattattcttcttgactaaaaagcgaagacagagacagcggcttgcagtttcctcaagaggagagaacttagtccaccaaattcaataccgggagatgaattcttgcctgaatgcagatgatctggacctaatgaattcctcagaaaattcccatgagtcagctgatttcagtgctgctgaactaatttctgtgtctaaatttcttcctatttctggaatggaaaaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgttattgatttgagtttgctttaatt

SEQ ID NO: 23 - DNA, 3806 bp, Homo sapiens; identical to SEQ ID NO: 22

SEQ ID NO: 24 - DNA, 2508 bp, Homo sapiens
ctttctgctgttaccgggagcgcggtggccacggaacgctgcccggagccgcgcgagggaggacccgacgcgcggcgtttacccagcgcagcgttccaccgctcgggtttggctggaatagctctccagacccccagctggccatgtggtgagttcagggcccaaatcaagtagtaccagcaatcagggaactcctatctgttttgaatggattcacaccagccacaagcctggaaagatggtgtcacaatctacagtcaggcaggattctcctgtggagccctgggaagggatcagcgatcactctggcattattgatggttcgcccagactcctgaacactgaccatcctccttgccaattagacatcaggctcatgaggcacaaagctgtctggattaacccccaggatgtgcagcaacagccgcaggacttgcaatctcaggtgccagcagcagggaacagtgggacccattttgtgacagatgctgcctctccctcaggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctaggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaaaaaaaaaaaaaaaa

SEQ ID NO: 25 - DNA, 925 bp, Homo sapiens
atgggcaaaggcttccctggaatctcccacactgtctgctccctataaaaggcaggcagatgggccagaggagcagagaggctgagaccaacccagaaaccaccacctctcacgccaaagctcacaccttcagcctccaacatgaaggtctccgcagcacttctgtggctgctgctcatagcagctgccttcagcccccaggggctcgctgggccagcttctgtcccaaccacctgctgctttaacctggccaataggaagataccccttcagcgactagagagctacaggagaatcaccagtggcaaatgtccccagaaagctgtgatcttcaagaccaaactggccaaggatatctgtgccgaccccaagaagaagtgggtgcaggattccatgaagtatctggaccaaaaatctccaactccaaagccataaataatcaccatttttgaaaccaaaccagagcctgagtgttgcctaatttgttttcccttcttacaatgcattctgaggtaacctcattatcagtccaaagggcatgggttttattatatatatatatttttttttttaaaaaaaaaacgtattgcatttaatttattgaggctttaaaacttatcctccatgaatatcagttatttttaaactgtaaagctttgtgcagattctttaccccctgggagccccaattcgatcccctgtcacgtgtgggcaatgttccccctctcctctcttcctccctggaatcttgtaaaggtcctggcaaagatgatcagtatgaaaatgtcattgttcttgtgaacccaaagtgtgactcattaaatggaagtaaatgttgttttaggaatacataaagtatgtgcatattttattatagtcactagttgtaatttttttgtgggaaatccacactgagctgaggggg

SEQ ID NO: 26 - DNA, 8082 bp, Homo sapiens
gtgacggcctcggccgcgggcgtttacactggctctgcctccggcatctcttcgccggtgcgtcctcgccgcgcccgtaggtcccggcagccgggccccgcctccttcggagtccgagcgatgggcggggaaagggacaggcaggtatagctctgtcggcgccgcggtgtccacctcagtcaggccacggtggaagacgcgtgccgcggcgcctggttgcctgcagcggcccggacccgagaggaagctgaaccatctatctccagaaatgtcttcagaaagtaaagagcaacataacgtttcacccagagactcagctgaaggaaatgacagttatccatctgggatccatctggaacttcaaagggaatcaagtactgacttcaagcaatttgagaccaatgatcaatgcagaccttatcataggatccttattgagcgtcaagagaaatcagatacaaacttcaaggagtttgttattaaaaagctgcagaagaattgccagtgcagtccagccaaagccaaaaatatgattttaggtttccttcctgttttgcagtggctcccaaaatacgacctaaagaaaaacattttaggggatgtgatgtcaggcttgattgtgggcatattattggtgccccagtccattgcttattccctgctggctggccaagaacctgtctatggtctgtacacatctttttttgccagcatcatttattttctcttgggtacctcccgtcacatctctgtgggcatttttggagtactgtgccttatgattggtgagacagttgaccgagaactacagaaagctggctatgacaatgcccatagtgctccttccttaggaatggtttcaaatgggagcacattattaaatcatacatcagacaggatatgtgacaaaagttgctatgcaattatggttggcagcactgtaacctttatagctggagtttatcaggtagcgatgggcttctttcaagtgggttttgtttctgtctacctctcagatgccttgctgagtggatttgtcactggtgcctccttcactattcttacatctcaggccaagtatcttcttgggctcaaccttcctcggactaatggtgtgggctcactcatcactacctggatacatgtcttcagaaacatccataagaccaatctctgtgatcttatcaccagccttttgtgccttttggttcttttgccaaccaaagaactcaatgaacacttcaaatccaagcttaaggcaccgattcctattgaacttgttgttgttgtagcagccacattagcctctcattttggaaaactacatgaaaattataattctagtattgctggacatattcccactgggtttatgccacccaaagtaccagaatggaacctaattcctagtgtggctgtagatgcaatagctatttccatcattggttttgctatcactgtatcactttctgagatgtttgccaagaaacatggttacacagtcaaagcaaaccaggaaatgtatgccattggcttttgtaatatcatcccttccttcttccactgttttactactagtgcagctcttgcaaagacattggttaaagaatcaacaggctgccatactcagctttctggtgtggtaacagccctggttcttttgttggtcctcctagtaatagctcctttgttctattcccttcaaaaaagtgtccttggtgtgatcacaattgtaaatctacggggagcccttcgtaaatttagggatcttcccaaaatgtggagtattagtagaatggatacagttatctggtttgttactatgctgtcctctgcactgctaagtactgaaataggcctacttgttggggtttgtttttctatattttgtgtcatcctccgcactcagaagccaaagagttcactgcttggcttggtggaagagtctgaggtctttgaatctgtgtctgcttacaagaaccttcagattaagccaggcatcaagattttccgctttgtagcccctctctactacataaacaaagaatgctttaaatctgctttatacaaacaaactgtcaacccaatcttaataaaggtggcttggaagaaggcagcaaagagaaagatcaaagaaaaagtagtgactcttggtggaatccaggatgaaatgtcagtgcaactttcccatgatcccttggagctgcatactatagtgattgactgcagtgcaattcaatttttagatacagcagggatccacacactgaaagaagttcgcagagattatgaagccattggaatccaggttctgctggctcagtgcaatcccactgtgagggattccctaaccaacggagaatattgcaaaaaggaagaagaaaaccttctcttctatagtgtgtatgaagcgatggcttttgcagaagtatctaaaaatcagaaaggagtatgtgttcccaatggtctgagtcttagtagtgattaattgagaaggtagatagaagaatgtctagccaataggttaaaatttcaagtgtccaacatttcccagttccacagtgggaaattttgcacacttgaaattttaaccaagtggctagatattattcctcctttgaagctaatggcatttgtatatacacactgcagcagagcttgtagctggacagagtcaaaaagaagaaaatacggtttcaggctttcttgcagatatgaagtattcttggaatgcaataagtatgtattgaactgtactgtaaagtagctccaaaacttaattactctcctgttttaggggttatacatttggactgtgcattctccaagagatgaagcggtgaagttgggatttacattggaagtgctgtagacttctttatgtggctcagtggagagagggaaagaatgttgcacctgctctagtaccataggtcaagaggcttctggatcacaaagtcataactagacaggtttgttcttgtagttttctatccccagtctttgctccccagatggcagtagtttttagtaggaaagtgccattcctgtccttaaggcacagtctcatcagaagtctaatacctgggcaggtttataacatcctgagagccagcctgacattagacagaataccctttgtaatacattggaaatttttactcatgcctttttgtttaggataaataggtaagcacaaagagctcttcaaaatcagaaaaaacaataggagtccttccttgtcttttctgtgatctctgtccttgtttctgagactttctctaccattaagctctattttagctttcagttattctagtttgtttcccatggaatctgtcctaaactggtgtttttgtcagtgacagtcttgccagtcagcaatttctaacagcattttaaatgagtttgatgtacagtaaatattgatgacaatgacagcttttaactcttcaagtcacctaaagctattatgcaggaggatttagaagtcacattcataaaacccaagtgctatgggtgtattattcatgatagctggcccacaggtcatgaattgaggaggaatttgctttcaaaaagcaagaatgtccaacactgaaagtttatagttttatatttggaccttgaaaggtaagaaaaaaccaggttctccaaagttaggaatagggaactaatttatgaaacagccatcttaaaaaaaaaaaaagtaaactgcaaaagtacaaaatcatttttcaatctgttcccagtttctaaacaattttaaatatttatgagaagcaaaccctatgtgtagggcatctgttggagtgggatgcttttagacatatattaagtatgtacatgtttaatatgtatatttaaaatgcatatatattttattatatctatattatcctatatagatatatgtaacttagctttattgttagctccataagctgccagtgttgcttttctgttggtagagctctcccatttggtgacatggaaaatacctttccattatcacaacaaagcagttgctcagtagaaagtctagatttctgtcttataggtgatttctgtcttataggtgattataatcaagtgtaggcttcctgaattttgacatccttttagaacttgggtctggaattccagaaatgttaattgctgcttgtatttgttcttgtttgttttttagccagtatttgccctttctatccagccttatgaataatagcagtaaaatcacagtatcttggtcagtctttatttttttccttttttcttttttaagagacagtcatccaggccagagtgcagtttgatgatagcttactgaagcttcccactcctgggctcaagttatccttccattttggcctcctgagtagctagaccataggtatgcatcaccacaccctgctaattttttaaatttttttctagagagagggtctcactgtgttgcccaggctggtctcaaactccaggctcaagcaatccttcagcctcagcctcccagagtgttgggattacaggcgtgagccactgcacttggccaagttatttatttttaatctctcttgcccttctcccaaggcaggcttaagttgagactattataggtgtctaataacctgtgacagagtaatgagtacatgcttaagatgttataattagccaacaccaacacagcaaaaaatataattccagccaaagattctggaaaatccctcagaaggagggataacaggatttgacctttaccagcgatttctgtccatatgtggatgtaaacagttctggaacgttatgcatgcagttagcgaatccttgaattatgttctggtttgtacttgtcccatccatccaaacaagagattctgcttttggtagccatctgtagaaacatttaagatgtcactagaatttacatttcatcctctctacttgggttgaggttgcctatacttgcatattgttaaaatgttttggttgctgatattcagaggaatgaaacctggaaccaaagcctaatttgccgataaaaaaactgttttcggccaggtgcagtggctcatgcctgtaatcccagcacgttgggaggccgaggcgggtggatcacctgaagtcaggagttcgagaccatcctggctaacactgtgaaaccccgtctctactaaaaatacaaaaaattagcggggcatggtggcacgcgcctgtagtcccagctactcaggaggctgaggcaggagaattacttgaacccgggaggcggaggttgcagtaagcagagattgtgccactggactccagcctgggtgacagagcgagactccgtctcaaacaaacaaacaaaaaactgttttcatttgctctcttgaccaaaggataggactttagttctttaagcattattttaaacactatattgatacaaaaatatcttgcttactctaaactttagagtctaaatgaagctttttctcagtacaagattctgagtatcataaaatggttatttaattgaaacgtagtgtggtatactcttgatggttagaactcttacagccttatttatttttaagtttgttacagccaaagggttggagtgtgccagtgcacaggtagactaaggaaaacattatagaggagtgaagagaacagaccattgaaaagactattatctgaccagcggaggcagaaaagagaggaacccagttgaataggatccaatccctggttagcctctacacaataatagggagacaaggattaggagccatacctcccagagcaaggtatctttctagagcaaatttctctttctagaaggggagggtcacagggtcacagattcaccaaagctgaaagggctgaggagctcatggtagcctgggctgacctactctggagcacggtgtcttccttctaaactgagtgactgtagtactatctgtgcctctgatggtaataaaactgacaagatgtctaatttttttttaagtaggaccaaaggaaaacaagatttagatagtctgactttgcttttgaacaacagacattgcaagtcaaaattgttgtcaaatttacatatggtaaatgatgaactttaaaaatgtgtccaggtgttagatgagttcattagactcttttaatgctaatggctagtacgtttaaacaaaacagcagttctctgctgcaatattcccattgaccacttaaatgaccataagtggtcatttaagaacatgttagggttagccctgatctgaatataaaagtgagaaaagggctacagtgcatttcttggtaacttaaactgagtcttgaagttataatgatccattcgagttctgtgatccttattgttcttaattgtgtttctctacgtattgttacagatgagccatacgtttctttgtatcaatgtagacatgacttcagatacctctgaggacctacccagcagtctaggaccctgggccaagtgctgggactatggtactaaatccagtagatgggctgtgtagcaactctcccagggaacacactagggtacttagggaggtgctttgtggagcatgttgaagctttgagatctgagcaggaggcagtgatgtccctggtctattcagggaaagatttcagtgtgaaatggtaaacatccaattgacaggatttagattttgcttagtttttctgctttttaatgtttctatcccccatctcagtgttttctttatccatcccagtgatgccttatttgaaactgggcttaaactgcaaaaagaatgaagttggatttaggaagctgttagatcattgagtggtgttgagagtgaagtttcactagcagggaagtttccttgagcctaaaataaaaagaaaaaattaaaaagaatcagtttttttaattaaaaaaatagaaagctgttaggctcctaattcgtggggtttttttttgtaaaaacagtttagataatcctgaatgcaatcattaacttggttgctaattacaagaatgaaaattataatggaaaaggacaaaataatataccagctggtttgttattatagtccgtgtattaaaatactattgaaatacgttaaaggtaaatttttaaggtttaaaaaaaatttagtaacttacagggatggagaatttagatgtcagaggtggggagatttatttttataaggtaatttttatcctgataaggacttaaaaaaaagttttgcaactgaaattttaaagtaaacatgttaagtacagttaaaaagtaagcattgtagtaaatagtggattctctggtgtgtattttttatctcagtgttgaaaattggaaaagaatggactgaagtctaaaaactggaataatgaaggacactaaatgcctttattgtagatactatgtttgtaagtctatagctaagcaacttaagccaaaaaggtctttcaactgaagctttaatcaacttattttggagatgttctcttcccttatctcatgcgtcatccctaaaataataagatacatgggatcaaatagcccttgccttttcaacacaaatcagttggaaaattatggtttgagtcctgttgctgccatggcttctgtttctcagaaatgagtgtgtatgaacataccaatctatgtaataggctacctttttttgtcttctttggaactttgtacacaaaccaagacaatatcagggtgacaggtgaatgaacttaaattctcagtcttgtctattcaccaaaaaagtatactgcctgttttttctttaattattcaaggttgatgacttttaggaacatgttttatactgtattttttaattaaagcaagtgccttgatgtaattccatgtaaatcattgcttaaccctcttatgggatgaggatgagttattaatgtattgcagcctactggaaaggagggggagttggttaatagcagatacttttcttctagaagcttatgttttatgctgtttattatgtaagatcctgtatgtgtgttgagatttagaggtttcatttgttttgtctgctaataaattgttactctaataataaaaaaaa

SEQ ID NO: 27 - DNA, 1190 bp, Homo sapiens
cagatccatcaggtccgagctgtgttgactaccacttttcccttcgtctcaattatgtcttggaaaaaggctttgcggatccccggaggccttcgggcagcaactgtgaccttgatgctgtcgatgctgagcaccccagtggctgagggcagagactctcccgaggatttcgtgtaccagtttaagggcatgtgctacttcaccaacgggacagagcgcgtgcgtcttgtgagcagaagcatctataaccgagaagagatcgtgcgcttcgacagcgacgtgggggagttccgggcggtgacgctgctggggctgcctgccgccgagtactggaacagccagaaggacatcctggagaggaaacgggcggcggtggacagggtgtgcagacacaactaccagttggagctccgcacgaccttgcagcggcgagtggagcccacagtgaccatctccccatccaggacagaggccctcaaccaccacaacctgctggtctgctcggtgacagatttctatccagcccagatcaaagtccggtggtttcggaatgaccaggaggagacagctggcgttgtgtccaccccccttattaggaatggtgactggaccttccagatcctggtgatgctggaaatgactccccagcgtggagacgtctacacctgccacgtggagcaccccagcctccagagccccatcaccgtggagtggcgggctcaatctgaatctgcccagagcaagatgctgagtggcattggaggcttcgtgctggggctgatcttcctcgggctgggccttatcatccatcacaggagtcagaaagggctcctgcactgactcctgagactattttaactgggattggttatcacttttctgtaacgcctgcttgtccctgcccagaattcccagctgtctgtgtcagcctgtccccctgagatcagagtcctacagtggctgtcacgcagccaccaggtcatctcctttcatccccaccttgaggcggatggctgtgaccctacttcctgcactgacccacagcctctgcctgtgcacggccagctgcatctactcaggccccaaggggtttctgtttctattctctcctcagactgctcaagagaagcacatgaaaaccattacctgactttagagcttttttacataattaaacatgatcctgagtt

SEQ ID NO: 28 - DNA, 3276 bp, Homo sapiens
aatagactaaacccagagcctcaaagcagtgcactccgtgaaggcaaagagaacacgctgcaaaaggctttccaagaatcctcgacatggcaaggaggagctcgttccagtcgtgtcagataatatccctgttcacttttgccgttggagtcaatatctgcttaggattcactgcacatcgaattaagagagcagaaggatgggaggaaggtcctcctacagtgctatcagactccccctggaccaacatctccggatcttgcaagggcaggtgctttgaacttcaagaggctggacctcctgattgtcgctgtgacaacttgtgtaagagctataccagttgctgccatgactttgatgagctgtgtttgaagacagcccgtggctgggagtgtactaaggacagatgtggagaagtcagaaatgaagaaaatgcctgtcactgctcagaggactgcttggccaggggagactgctgtaccaattaccaagtggtttgcaaaggagagtcgcattgggttgatgatgactgtgaggaaataaaggccgcagaatgccctgcagggtttgttcgccctccattaatcatcttctccgtggatggcttccgtgcatcatacatgaagaaaggcagcaaagtcatgcctaatattgaaaaactaaggtcttgtggcacacactctccctacatgaggccggtgtacccaactaaaacctttcctaacttatacactttggccactgggctatatccagaatcacatggaattgttggcaattcaatgtatgatcctgtatttgatgccacttttcatctgcgagggcgagagaaatttaatcatagatggtggggaggtcaaccgctatggattacagccaccaagcaaggggtgaaagctggaacattcttttggtctgttgtcatccctcacgagcggagaatattaaccatattgcagtggctcaccctgccagatcatgagaggccttcggtctatgccttctattctgagcaacctgatttctctggacacaaatatggccctttcggccctgaggagagtagttatggctcaccttttactccggctaagagacctaagaggaaagttgcccctaagaggagacaggaaagaccagttgctcctccaaagaaaagaagaagaaaaatacataggatggatcattatgctgcggaaactcgtcaggacaaaatgacaaatcctctgagggaaatcgacaaaattgtggggcaattaatggatggactgaaacaactaaaactgcatcggtgtgtcaacgtcatctttgtcggagaccatggaatggaagatgtcacatgtgatagaactgagttcttgagtaattacctaactaatgtggatgatattactttagtgcctggaactctaggaagaattcgatccaaatttagcaacaatgctaaatatgaccccaaagccattattgccaatctcacgtgtaaaaaaccagatcagcactttaagccttacttgaaacagcaccttcccaaacgtttgcactatgccaacaacagaagaattgaggatatccatttattggtggaacgcagatggcatgttgcaaggaaacctttggatgtttataagaaaccatcaggaaaatgctttttccagggagaccacggatttgataacaaggtcaacagcatgcagactgtttttgtaggttatggctcaacatttaagtacaagactaaagtgcctccatttgaaaacattgaactttacaatgttatgtgtgatctcctgggattgaagccagctcctaataatgggacccatggaagtttgaatcatctcctgcgcactaataccttcaggccaaccatgccagaggaagttaccagacccaattatccagggattatgtaccttcagtctgattttgacctgggctgcacttgtgatgataaggtagagccaaagaacaagttggatgaactcaacaaacggcttcatacaaaagggtctacagaagagagacacctcctctatgggcgacctgcagtgctttatcggactagatatgatatcttatatcacactgactttgaaagtggttatagtgaaatattcctaatgccactctggacatcatatactgtttccaaacaggctgaggtttccagcgttcctgaccatctgaccagttgcgtccggcctgatgtccgtgtttctccgagtttcagtcagaactgtttggcctacaaaaatgataagcagatgtcctacggattcctctttcctccttatctgagctcttcaccagaggctaaatatgatgcattccttgtaaccaatatggttccaatgtatcctgctttcaaacgggtctggaattatttccaaagggtattggtgaagaaatatgcttcggaaagaaatggagttaacgtgataagtggaccaatcttcgactatgactatgatggcttacatgacacagaagacaaaataaaacagtacgtggaaggcagttccattcctgttccaactcactactacagcatcatcaccagctgtctggatttcactcagcctgccgacaagtgtgacggccctctctctgtgtcctccttcatcctgcctcaccggcctgacaacgaggagagctgcaatagctcagaggacgaatcaaaatgggtagaagaactcatgaagatgcacacagctagggtgcgtgacattgaacatctcaccagcctggacttcttccgaaagaccagccgcagctacccagaaatcctgacactcaagacatacctgcatacatatgagagcgagatttaactttctgagcatctgcagtacagtcttatcaactggttgtatatttttatattgtttttgtatttattaatttgaaaccaggacattaaaaatgttagtattttaatcctgtaccaaatctgacatattatgcctgaatgactccactgtttttctctaatgcttgatttaggtagccttgtgttctgagtagagcttgtaataaatactgcagcttgagtttttagtggaagcttctaaatggtgctgcagatttgatatttgcattgaggaaatattaattttccaatgcacagttgccacatttagtcctgtactgtatggaaacactgattttgtaaagttgcctttatttgctgttaactgttaactatgacagatatatttaagccttataaaccaatcttaaacataataaatcacacattcagttttttctggt

SEQ ID NO: 29 - DNA, 802 bp, Homo sapiens
accaccatgaatctacttctgatccttacctttgttgcagctgctgttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtgccgactacccagacgagctgcagtgcctggatgctcctgtgctgagccaggctgagtgtgaagcctcctaccctggaaagattaccaacaacatgttctgtgtgggcttcctcgagggaggcaaggattcctgccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcac

SEQ ID NO: 30 - DNA, 1691 bp, Homo sapiens
aacttcagtttgttggctgcggcagcaggtagcaaagtgacgccgagggcctgagtgctccagtagccaccgcatctggagaaccagcggttaccatggaggggatcagtatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaaaagacttttttttatacgataaataacttttttttaagttacacatttttcagatataaaagactgaccaatattgtacagtttttattgcttgttggatttttgtcttgtgtttctttagtttttgtgaagtttaattgacttatttatataaattttttttgtttcatattgatgtgtgtctaggcaggacctgtggccaagttcttagttgctgtatgtctcgtggtaggactgtagaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgtattaagttgttaataaaagtacatgttaaacttaaaaaaaaaaaaaaaaaa

SEQ ID NO: 31 - DNA, 2558 bp, Homo sapiens
ttgtgctcctcgcttgcctgttccttttccacgcattttccaggataactgtgactccaggcccgcaatggatgccctgcaactagcaaattcggcttttgccgttgatctgttcaaacaactatgtgaaaaggagccactgggcaatgtcctcttctctccaatctgtctctccacctctctgtcacttgctcaagtgggtgctaaaggtgacactgcaaatgaaattggacaggttcttcattttgaaaatgtcaaagatataccctttggatttcaaacagtaacatcggatgtaaacaaacttagttccttttactcactgaaactaatcaagcggctctacgtagacaaatctctgaatctttctacagagttcatcagctctacgaagagaccctatgcaaaggaattggaaactgttgacttcaaagataaattggaagaaacgaaaggtcagatcaacaactcaattaaggatctcacagatggccactttgagaacattttagctgacaacagtgtgaacgaccagaccaaaatccttgtggttaatgctgcctactttgttggcaagtggatgaagaaatttcctgaatcagaaacaaaagaatgtcctttcagactcaacaagacagacaccaaaccagtgcagatgatgaacatggaggccacgttctgtatgggaaacattgacagtatcaattgtaagatcatagagcttccttttcaaaataagcatctcagcatgttcatcctactacccaaggatgtggaggatgagtccacaggcttggagaagattgaaaaacaactcaactcagagtcactgtcacagtggactaatcccagcaccatggccaatgccaaggtcaaactctccattccaaaatttaaggtggaaaagatgattgatcccaaggcttgtctggaaaatctagggctgaaacatatcttcagtgaagacacatctgatttctctggaatgtcagagaccaagggagtggccctatcaaatgttatccacaaagtgtgcttagaaataactgaagatggtggggattccatagaggtgccaggagcacggatcctgcagcacaaggatgaattgaatgctgaccatccctttatttacatcatcaggcacaacaaaactcgaaacatcattttctttggcaaattctgttctccttaagtggcatagcccatgttaagtcctccctgacttttctgtggatgccgatttctgtaaactctgcatccagagattcattttctagatacaataaattgctaatgttgctggatcaggaagccgccagtacttgtcatatgtagccttcacacagatagacctttttttttttccaattctatcttttgtttccttttttcccataagacaatgacatacgcttttaatgaaaaggaatcacgttagaggaaaaatatttattcattatttgtcaaattgtccggggtagttggcagaaatacagtcttccacaaagaaaattcctataaggaagatttggaagctcttcttcccagcactatgctttccttctttgggatagagaatgttccagacattctcgcttccctgaaagactgaagaaagtgtagtgcatgggacccacgaaactgccctggctccagtgaaacttgggcacatgctcaggctactataggtccagaagtccttatgttaagccctggcaggcaggtgtttattaaaattctgaattttggggattttcaaaagataatattttacatacactgtatgttatagaacttcatggatcagatctggggcagcaacctataaatcaacaccttaatatgctgcaacaaaatgtagaatattcagacaaaatggatacataaagactaagtagcccataaggggtcaaaatttgctgccaaatgcgtatgccaccaacttacaaaaacacttcgttcgcagagcttttcagattgtggaatgttggataaggaattatagacctctagtagctgaaatgcaagaccccaagaggaagttcagatcttaatataaattcactttcatttttgatagctgtcccatctggtcatgtggttggcactagactggtggcaggggcttctagctgactcgcacagggattctcacaatagccgatatcagaatttgtgttgaaggaacttgtctcttcatctaatatgatagcgggaaaaggagaggaaactactgcctttagaaaatataagtaaagtgattaaagtgctcacgttaccttgacacatagtttttcagtctatgggtttagttactttagatggcaagcatgtaacttatattaatagtaatttgtaaagttgggtggataagctatccctgttgccggttcatggattacttctctataaaaaatatatatttaccaaaaaattttgtgacattccttctcccatctcttccttgacatgcattgtaaataggttcttcttgttctgagattcaatattgaatttctcctatgctattgacaataaaatattattgaactacc

SEQ ID NO: 32 - DNA, 1501 bp, Homo sapiens
agcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagttcgcgcgcttcgacagcgacgtgggggagttccgggcggtgacggagctggggcggcctgctgcggagtactggaacagccagaaggacatcctggaggagaagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacacttt

SEQ ID NO: 33 - DNA, 503 bp, Homo sapiens
cacctagcagttggttggcaaccccttcctcagtcccctgctgaaaaccctccagtcagcgcttatcccttctgctctctcccctcacccagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccagatcaa

SEQ ID NO: 34 - DNA, 1666 bp, Homo sapiens
ctccataaggcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgaggccaagggccaagagaatatccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaacaaacaattgggtacccagttaaattttcatttcagataaacaacaaataattttttagtataagtacattattgtttatctgaaattttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaaaaaaaaaaaaaaa

SEQ ID NO: 35 - DNA, 1666 bp, Homo sapiens; identical to SEQ ID NO: 34

SEQ ID NO: 36 - DNA, 402 bp, Homo sapiens
atgaaaccccagtttgttgggatcttgctcagctccctgctaggggctgccttgggaaaccgaatgcggtgctacaactgtggtggaagccccagcagttcttgcaaagaggccgtgaccacctgtggcgagggcagaccccagccaggcctggaacagatcaagctacctggaaaccccccagtgaccttgattcaccaacatccagcctgcgtcgcagcccatcattgcaatcaagtggagacagagtcggtgggagacgtgacttatccagcccacagggactgctacctgggagacctgtgcaacagcgccgtggcaagccatgtggcccctgcaggcattttggctgcagcagctaccgccctgacctgtctcttgccaggactgtggagcggatag

SEQ ID NO: 37 - DNA, 1707 bp, Homo sapiens
gggaagctccaggcaaacagcccagcaaacagcagcactcagctaaaaggaagactcacagaacacagttgaagaaggaaagtggcgatggacctcatcccaaatttggcggtggaaacctggcttctcctggctgtcagcctggtgctcctctatctatatgggacccgtacacatggactttttaagagactgggaattccagggcccacacctctgcctttgttgggaaatgttttgtcctatcgtcagggtctctggaaatttgacacagagtgctataaaaagtatggaaaaatgtggggaacgtatgaaggtcaactccctgtgctggccatcacagatcccgacgtgatcagaacagtgctagtgaaagaatgttattctgtcttcacaaatcgaaggtctttaggcccagtgggatttatgaaaagtgccatctctttagctgaggatgaagaatggaagagaatacggtcattgctgtctccaaccttcaccagcggaaaactcaaggagatgttccccatcattgcccagtatggagatgtattggtgagaaacttgaggcgggaagcagagaaaggcaagcctgtcaccttgaaagacatctttggggcctacagcatggatgtgattactggcacatcatttggagtgaacatcgactctctcaacaatccacaagacccctttgtggagagcactaagaagttcctaaaatttggtttcttagatccattatttctctcaataatactctttccattccttaccccagtttttgaagcattaaatgtctctctgtttccaaaagataccataaattttttaagtaaatctgtaaacagaatgaagaaaagtcgcctcaacgacaaacaaaagcaccgactagatttccttcagctgatgattgactcccagaattcgaaagaaactgagtcccacaaagctctgtctgatctggagctcgcagcccagtcaataatcttcatttttgctggctatgaaaccaccagcagtgttctttccttcactttatatgaactggccactcaccctgatgtccagcagaaactgcaaaaggagattgatgcagttttgcccaataaggcaccacctacctatgatgccgtggtacagatggagtaccttgacatggtggtgaatgaaacactcagattattcccagttgctattagacttgagaggacttgcaagaaagatgttgaaatcaatggggtattcattcccaaagggtcaatggtggtgattccaacttatgctcttcaccatgacccaaagtactggacagagcctgaggagttccgccctgaaaggttcagtaagaagaaggacagcatagatccttacatatacacaccctttggaactggacccagaaactgcattggcatgaggtttgctctcatgaacatgaaacttgctctaatcagagtccttcagaacttctccttcaaaccttgtaaagaaacacagatccccttgaaattagacacgcaaggacttcttcaaccagaaaaacccattgttctaaaggtggattcaagagatggaaccctaagtggagaatgagttattctaaggatttctactttggtcttcaagaaagctgtgccccagaacaccagagatttcaacttagtcaataaaaccttgaaataaagatgggcttaatctaatgta

SEQ ID NO: 38 - DNA, 11185 bp, Homo sapiens
gctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacctaaagaggctacaaccatcgatttgagtatcctcgcagaaactgcatcacccagtttatccaaagaaccacaaatggtttctgatagaactacaccaatcatccctttagttgatgaattacctgtcattccaacagagttccctcccgtgggaaatattgtcagttttgaacagaaagccacagtccaacctcaggctatcacagatagtttagccaccaaattacccacacctactggcagtaccaagaagccctgggatatggatgactactcaccttctgcttcaggacctcttggaaagctagacatatcagaaattaaggaagaagtgctccagagtacaactggcgtctctcattatgctacggattcatgggatggtgtcgtggaagataaacaaacacaagaatcggttacacagattgaacaaatagaagtgggtcctttggtaacatctatggaaatcttaaagcacattccttccaaggaattccctgtaactgaaacaccattggtaactgcaagaatgatcctggaatccaaaactgaaaagaaaatggtaagcactgtttctgaattggtaaccacaggtcactatggattcaccttgggagaagaggatgatgaagacagaacacttacagttggatctgatgagagcaccttgatctttgaccaaattcctgaagtcattacggtgtcaaagacttcagaagacaccatccacactcatttagaagacttggagtcagtctcagcatccacaactgtttcccctttaattatgcctgataataatggatcatccatggatgactgggaagagagacaaactagtggtaggataacggaagagtttcttggcaaatatctgtctactacaccttttccatcacagcatcgtacagaaatagaattgtttccttattctggtgataaaatattagtagagggaatttccacagttatttatccttctctacaaacagaaatgacacatagaagagaaagaacagaaacactaataccagagatgagaacagatacttatacagatgaaatacaagaagagatcactaaaagtccatttatgggaaaaacagaagaagaagtcttctctgggatgaaactctctacatctctctcagagccaattcatgttacagagtcttctgtggaaatgaccaagtcttttgatttcccaacattgataacaaagttaagtgcagagccaacagaagtaagagatatggaggaagactttacagcaactccaggtactacaaaatatgatgaaaatattacaacagtgcttttggcccatggtactttaagtgttgaagcagccactgtatcaaaatggtcatgggatgaagataatacaacatccaagcctttagagtctacagaaccttcagcctcttcaaaattgccccctgccttactcacaactgtggggatgaatggaaaggataaagacatcccaagtttcactgaagatggagcagatgaatttactcttattccagatagtactcaaaagcagttagaggaggttactgatgaagacatagcagcccatggaaaattcacaattagatttcagccaactacatcaactggtattgcagaaaagtcaactttgagagattctacaactgaagaaaaagttccacctatcacaagcactgaaggccaagtttatgcaaccatggaaggaagtgctttgggtgaagtagaagatgtggacctctctaagccagtatctactgttccccaatttgcacacacttcagaggtggaaggattagcatttgttagttatagtagcacccaagagcctactacttatgtagactcttcccataccattcctctttctgtaattcccaagacagactggggagtgttagtaccttctgttccatcagaagatgaagttctaggtgaaccctctcaagacatacttgtcattgatcagactcgccttgaagcgactatttctccagaaactatgagaacaacaaaaatcacagagggaacaactcaggaagaattcccttggaaagaacagactgcagagaaaccagttcctgctctcagttctacagcttggactcccaaggaggcagtaacaccactggatgaacaagagggcgatggatcagcatatacagtctctgaagatgaattgttgacaggttctgagagggtcccagttttagaaacaactccagttggaaaaattgatcacagtgtgtcttatccaccaggtgctgtaactgagcacaaagtgaaaacagatgaagtggtaacactaacaccacgcattgggccaaaagtatctttaagtccagggcctgaacaaaaatatgaaacagaaggtagtagtacaacaggatttacatcatctttgagtccttttagtacccacattacccagcttatggaagaaaccactactgagaaaacatccctagaggatattgatttaggctcaggattatttgaaaagcccaaagccacagaactcatagaattttcaacaatcaaagtcacagttccaagtgatattaccactgccttcagttcagtagacagacttcacacaacttcagcattcaagccatcttccgcgatcactaagaaaccacctctcatcgacagggaacctggtgaagaaacaaccagtgacatggtaatcattggagaatcaacatctcatgttcctcccactacccttgaagatattgtagccaaggaaacagaaaccgatattgatagagagtatttcacgacttcaagtcctcctgctacacagccaacaagaccacccactgtggaagacaaagaggcctttggacctcaggcgctttctacgccacagcccccagcaagcacaaaatttcaccctgacattaatgtttatattattgaggtcagagaaaataagacaggtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcagaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatcagaacatttttcaggtggtgagcctgatgttttccccacagtcccattccatgaggaatttgaaagtggaacagccaaaaaaggggcagaatcagtcacagagagagatactgaagttggtcatcaggcacatgaacatactgaacctgtatctctgtttcctgaagagtcttcaggagagattgccattgaccaagaatctcagaaaatagcctttgcaagggctacagaagtaacatttggtgaagaggtagaaaaaagtacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacagtctgaaagggaaatgacagattctactcctgtctttacagaaacaaatacattagaaaatttgggggcacagaccactgagcacagcagtatccatcaacctggggttcaggaagggctgaccactctcccacgtagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaactacattctccactgagccaacaggactggttttgagtacagtaatggacagagtagttgctgaaaatataacccaaacatccagggaaatagtgatttcagagcgattaggagaaccaaattatggggcagaaataaggggcttttccacaggttttcctttggaggaagatttcagtggtgactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatcaaaaaggaagaaagtacaaaacattttccgaaaggcatgagaccaacaattcaagagtcagatactgagctcttattctctggactgggatcaggagaagaagttttacctactctaccaacagagtcagtgaattttactgaagtggaacaaatcaataacacattatatccccacacttctcaagtggaaagtacctcaagtgacaaaattgaagactttaacagaatggaaaatgtggcaaaagaagttggaccactcgtatctcaaacagacatctttgaaggtagtgggtcagtaaccagcacaacattaatagaaattttaagtgacactggagcagaaggacccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatggccaaagaatttgttacatcagcaccaaaaccatctgacttgtattatgaaccttctggagaaggatctggagaagtggatattgttgattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattcagagcagaacaaaagctcccctgatccaactagcacactgtcaaatacagtgtcatatgagaggtccacagacggtagtttccaagaccgtttcagggaattcgaggattccaccttaaaacctaacagaaaaaaacccactgaaaatattatcatagacctggacaaagaggacaaggatttaatattgacaattacagagagtaccatccttgaaattctacctgagctgacatcggataaaaatactatcatagatattgatcatactaaacctgtgtatgaagacattcttggaatgcaaacagatatagatacagaggtaccatcagaaccacatgacagtaatgatgaaagtaatgatgacagcactcaagttcaagagatctatgaggcagctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaaacagaattagacgttttacttcccacggcaacatccctgccaattcctcgtaagtctgccacagttattccagagattgaaggaataaaagctgaagcaaaagccctggatgacatgtttgaatcaagcactttgtctgatggtcaagctattgcagaccaaagtgaaataataccaacattgggccaatttgaaaggactcaggaggagtatgaagacaaaaaacatgctggtccttcttttcagccagaattctcttcaggagctgaggaggcattagtagaccatactccctatctaagtattgctactacccaccttatggatcagagtgtaacagaggtgcctgatgtgatggaaggatccaatcccccatattacactgatacaacattagcagtttcaacatttgcgaagttgtcttctcagacaccatcatctcccctcactatctactcaggcagtgaagcctctggacacacagagatcccccagcccagtgctctgccaggaatagacgtcggctcatctgtaatgtccccacaggattcttttaaggaaattcatgtaaatattgaagcaactttcaaaccatcaagtgaggaataccttcacataactgagcctccctctttatctcctgacacaaaattagaaccttcagaagatgatggtaaacctgagttattagaagaaatggaagcttctcccacagaacttattgctgtggaaggaactgagattctccaagatttccaaaacaaaaccgatggtcaagtttctggagaagcaatcaagatgtttcccaccattaaaacacctgaggctggaactgttattacaactgccgatgaaattgaattagaaggtgctacacagtggccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagttgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccagg

SEQ ID NO: 39 - DNA, 1552 bp, Homo sapiens
gcccgtacacaccgtgtgctgggacaccccacagtcagccgcatggctcccctgtgccccagcccctggctccctctgttgatcccggcccctgctccaggcctcactgtgcaactgctgctgtcactgctgcttctgatgcctgtccatccccagaggttgccccggatgcaggaggattcccccttgggaggaggctcttctggggaagatgacccactgggcgaggaggatctgcccagtgaagaggattcacccagagaggaggatccacccggagaggaggatctacctggagaggaggatctacctggagaggaggatctacctgaagttaagcctaaatcagaagaagagggctccctgaagttagaggatctacctactgttgaggctcctggagatcctcaagaaccccagaataatgcccacagggacaaagaaggggatgaccagagtcattggcgctatggaggcgacccgccctggccccgggtgtccccagcctgcgcgggccgcttccagtccccggtggatatccgcccccagctcgccgccttctgcccggccctgcgccccctggaactcctgggcttccagctcccgccgctcccagaactgcgcctgcgcaacaatggccacagtgtgcaactgaccctgcctcctgggctagagatggctctgggtcccgggcgggagtaccgggctctgcagctgcatctgcactggggggctgcaggtcgtccgggctcggagcacactgtggaaggccaccgtttccctgccgagatccacgtggttcacctcagcaccgcctttgccagagttgacgaggccttggggcgcccgggaggcctggccgtgttggccgcctttctggaggagggcccggaagaaaacagtgcctatgagcagttgctgtctcgcttggaagaaatcgctgaggaaggctcagagactcaggtcccaggactggacatatctgcactcctgccctctgacttcagccgctacttccaatatgaggggtctctgactacaccgccctgtgcccagggtgtcatctggactgtgtttaaccagacagtgatgctgagtgctaagcagctccacaccctctctgacaccctgtggggacctggtgactctcggctacagctgaacttccgagcgacgcagcctttgaatgggcgagtgattgaggcctccttccctgctggagtggacagcagtcctcgggctgctgagccagtccagctgaattcctgcctggctgctggtgacatcctagccctggtttttggcctcctttttgctgtcaccagcgtcgcgttccttgtgcagatgagaaggcagcacagaaggggaaccaaagggggtgtgagctaccgcccagcagaggtagccgagactggagcctagaggctggatcttggagaatgtgagaagccagccagaggcatctgagggggagccggtaactgtcctgtcctgctcattatgccacttccttttaactgccaagaaattttttaaaataaatatttataat

SEQ ID NO: 40 - DNA, 3405 bp, Homo sapiens
cgcccaacccaagttcaaaggctgataagagagaaaatctcatgaggaggttttagtctagggaaagtcattcagtggatgtgatcttggctcacaggggacgatgtcaagctcttcctggctccttctcagccttgttgctgtaactgctgctcagtccaccattgaggaacaggccaagacatttttggacaagtttaaccacgaagccgaagacctgttctatcaaagttcacttgcttcttggaattataacaccaatattactgaagagaatgtccaaaacatgaataatgctggggacaaatggtctgcctttttaaaggaacagtccacacttgcccaaatgtatccactacaagaaattcagaatctcacagtcaagcttcagctgcaggctcttcagcaaaatgggtcttcagtgctctcagaagacaagagcaaacggttgaacacaattctaaatacaatgagcaccatctacagtactggaaaagtttgtaacccagataatccacaagaatgcttattacttgaaccaggtttgaatgaaataatggcaaacagtttagactacaatgagaggctctgggcttgggaaagctggagatctgaggtcggcaagcagctgaggccattatatgaagagtatgtggtcttgaaaaatgagatggcaagagcaaatcattatgaggactatggggattattggagaggagactatgaagtaaatggggtagatggctatgactacagccgcggccagttgattgaagatgtggaacatacctttgaagagattaaaccattatatgaacatcttcatgcctatgtgagggcaaagttgatgaatgcctatccttcctatatcagtccaattggatgcctccctgctcatttgcttggtgatatgtggggtagattttggacaaatctgtactctttgacagttccctttggacagaaaccaaacatagatgttactgatgcaatggtggaccaggcctgggatgcacagagaatattcaaggaggccgagaagttctttgtatctgttggtcttcctaatatgactcaaggattctgggaaaattccatgctaacggacccaggaaatgttcagaaagcagtctgccatcccacagcttgggacctggggaagggcgacttcaggatccttatgtgcacaaaggtgacaatggacgacttcctgacagctcatcatgagatggggcatatccagtatgatatggcatatgctgcacaaccttttctgctaagaaatggagctaatgaaggattccatgaagctgttggggaaatcatgtcactttctgcagccacacctaagcatttaaaatccattggtcttctgtcacccgattttcaagaagacaatgaaacagaaataaacttcctgctcaaacaagcactcacgattgttgggactctgccatttacttacatgttagagaagtggaggtggatggtctttaaaggggaaattcccaaagaccagtggatgaaaaagtggtgggagatgaagcgagagatagttggggtggtggaacctgtgccccatgatgaaacatactgtgaccccgcatctctgttccatgtttctaatgattactcattcattcgatattacacaaggaccctttaccaattccagtttcaagaagcactttgtcaagcagctaaacatgaaggccctctgcacaaatgtgacatctcaaactctacagaagctggacagaaactgttcaatatgctgaggcttggaaaatcagaaccctggaccctagcattggaaaatgttgtaggagcaaagaacatgaatgtaaggccactgctcaactactttgagcccttatttacctggctgaaagaccagaacaagaattcttttgtgggatggagtaccgactggagtccatatgcagaccaaagcatcaaagtgaggataagcctaaaatcagctcttggagataaagcatatgaatggaacgacaatgaaatgtacctgttccgatcatctgttgcatatgctatgaggcagtactttttaaaagtaaaaaatcagatgattctttttggggaggaggatgtgcgagtggctaatttgaaaccaagaatctcctttaatttctttgtcactgcacctaaaaatgtgtctgatatcattcctagaactgaagttgaaaaggccatcaggatgtcccggagccgtatcaatgatgctttccgtctgaatgacaacagcctagagtttctggggatacagccaacacttggacctcctaaccagccccctgtttccatatggctgattgtttttggagttgtgatgggagtgatagtggttggcattgtcatcctgatcttcactgggatcagagatcggaagaagaaaaataaagcaagaagtggagaaaatccttatgcctccatcgatattagcaaaggagaaaataatccaggattccaaaacactgatgatgttcagacctccttttagaaaaatctatgtttttcctcttgaggtgattttgttgtatgtaaatgttaatttcatggtatagaaaatataagatgataaagatatcattaaatgtcaaaactatgactctgttcagaaaaaaaattgtccaaagacaacatggccaaggagagagcatcttcattgacattgctttcagtatttatttctgtctctggatttgacttctgttctgtttcttaataaggattttgtattagagtatattagggaaagtgtgtatttggtctcacaggctgttcagggataatctaaatgtaaatgtctgttgaatttctgaagttgaaaacaaggatatatcattggagcaagtgttggatcttgtatggaatatggatggatcacttgtaaggacagtgcctgggaactggtgtagctgcaaggattgagaatggcatgcattagctcactttcatttaatccattgtcaaggatgacatgctttcttcacagtaactcagttcaagtactatggtgatttgcctacagtgatgtttggaatcgatcatgctttcttcaaggtgacaggtctaaagagagaagaatccagggaacaggtagaggacattgctttttcacttccaaggtgcttgatcaacatctccctgacaacacaaaactagagccaggggcctccgtgaactcccagagcatgcctgatagaaactcatttctactgttctctaactgtggagtgaatggaaattccaactgtatgttcaccctctgaagtgggtacccagtctcttaaatcttttgtatttgctcacagtgtttgagcagtgctgagcacaaagcagacactcaataaatgctagatttacacactcaaaaaaaaaaaa

SEQ ID NO: 41 - DNA, 1216 bp, Homo sapiens
ttcggcacttgggagaagatgtttgaaaaaactgactctgctaatgagcctggactcagagctcaagtctgaactctacctccagacagaatgaagttcatctcgacatctctgcttctcatgctgctggtcagcagcctctctccagtccaaggtgttctggaggtctattacacaagcttgaggtgtagatgtgtccaagagagctcagtctttatccctagacgcttcattgatcgaattcaaatcttgccccgtgggaatggttgtccaagaaaagaaatcatagtctggaagaagaacaagtcaattgtgtgtgtggaccctcaagctgaatggatacaaagaatgatggaagtattgagaaaaagaagttcttcaactctaccagttccagtgtttaagagaaagattccctgatgctgatatttccactaagaacacctgcattcttcccttatccctgctctggattttagttttgtgcttagttaaatcttttccagggagaaagaacttccccatacaaataaggcatgaggactatgtgaaaaataaccttgcaggagctgatggggcaaactcaagcttcttcactcacagcaccctatatacacttggagtttgcattcttattcatcagggaggaaagtttctttgaaaatagttattcagttataagtaatacaggattattttgattatatacttgttgtttaatgtttaaaatttcttagaaaacaatggaatgagaatttaagcctcaaatttgaacatgtggcttgaattaagaagaaaattatggcatatattaaaagcaggcttctatgaaagactcaaaaagctgcctgggaggcagatggaacttgagcctgtcaagaggcaaaggaatccatgtagtagatatcctctgcttaaaaactcactacggaggagaattaagtcctacttttaaagaatttctttataaaatttactgtctaagattaatagcattcgaagatccccagacttcatagaatactcagggaaagcatttaaagggtgatgtacacatgtatcctttcacacatttgccttgacaaacttctttcactcacatctttttcactgactttttttgtgggggcggggccggggggactctggtatctaattctttaatgattcctataaatctaatgacattcaataaagttgagcaaacattttactt

SEQ ID NO: 42 - DNA, 3307 bp, Homo sapiens
caccttctgcactgctcatctgggcagaggaagcttcagaaagctgccaaggcaccatctccaggaactcccagcacgcagaatccatctgagaatatgctgccacaaataccctttttgctgctagtatccttgaacttggttcatggagtgttttacgctgaacgataccaaatgcccacaggcataaaaggcccactacccaacaccaagacacagttcttcattccctacaccataaagagtaaaggtatagcagtaagaggagagcaaggtactcctggtccaccaggccctgctggacctcgagggcacccaggtccttctggaccaccaggaaaaccaggctacggaagtcctggactccaaggagagccagggttgccaggaccaccgggaccatcagctgtagggaaaccaggtgtgccaggactcccaggaaaaccaggagagagaggaccatatggaccaaaaggagatgttggaccagctggcctaccaggaccccggggcccaccaggaccacctggaatccctggaccggctggaatttctgtgccaggaaaacctggacaacagggacccacaggagccccaggacccaggggctttcctggagaaaagggtgcaccaggagtccctggtatgaatggacagaaaggggaaatgggatatggtgctcctggtcgtccaggtgagaggggtcttccaggccctcagggtcccacaggaccatctggccctcctggagtgggaaaaagaggtgaaaatggggttccaggacagccaggcatcaaaggtgatagaggttttccgggagaaatgggaccaattggcccaccaggtccccaaggccctcctggggaacgagggccagaaggcattggaaagccaggagctgctggagccccaggccagccagggattccaggaacaaaaggtctccctggggctccaggaatagctgggcccccagggcctcctggctttgggaaaccaggcttgccaggcctgaagggagaaagaggacctgctggccttcctgggggtccaggtgccaaaggggaacaagggccagcaggtcttcctgggaagccaggtctgactggaccccctgggaatatgggaccccaaggaccaaaaggcatcccgggtagccatggtctcccaggccctaaaggtgagacagggccagctgggcctgcaggataccctggggctaagggtgaaaggggttcccctgggtcagatggaaaaccagggtacccaggaaaaccaggtctcgatggtcctaagggtaacccagggttaccaggtccaaaaggtgatcctggagttggaggacctcctggtctcccaggccctgtgggcccagcaggagcaaagggaatgcccggacacaatggagaggctggcccaagaggtgcccctggaataccaggtactagaggccctattgggccaccaggcattccaggattccctgggtctaaaggggatccaggaagtcccggtcctcctggcccagctggcatagcaactaagggcctcaatggacccaccgggccaccagggcctccaggtccaagaggccactctggagagcctggtcttccagggccccctgggcctccaggcccaccaggtcaagcagtcatgcctgagggttttataaaggcaggccaaaggcccagtctttctgggacccctcttgttagtgccaaccagggggtaacaggaatgcctgtgtctgcttttactgttattctctccaaagcttacccagcaataggaactcccataccatttgataaaattttgtataacaggcaacagcattatgacccaaggactggaatctttacttgtcagataccaggaatatactatttttcataccacgtgcatgtgaaagggactcatgtttgggtaggcctgtataagaatggcacccctgtaatgtacacctatgatgaatacaccaaaggctacctggatcaggcttcagggagtgccatcatcgatctcacagaaaatgaccaggtgtggctccagcttcccaatgccgagtcaaatggcctatactcctctgagtatgtccactcctctttctcaggattcctagtggctccaatgtgagtacacacagagctaatctaaatcttgtgctagaaaaagcattctctaactctaccccaccctacaaaatgcatatggaggtaggctgaaaagaatgtaatttttattttctgaaatacagatttgagctatcagaccaacaaaccttccccctgaaaagtgagcagcaacgtaaaaacgtatgtgaagcctctcttgaatttctagttagcaatcttaaggctctttaaggttttctccaatattaaaaaatatcaccaaagaagtcctgctatgttaaaaacaaacaacaaaaaacaaacaacaaaaaaaaaattaaaaaaaaaaacagaaatagagctctaagttatgtgaaatttgatttgagaaactcggcatttcctttttaaaaaagcctgtttctaactatgaatatgagaacttctaggaaacatccaggaggtatcatataactttgtagaacttaaatacttgaatattcaaatttaaaagacactgtatcccctaaaatatttctgatggtgcactactctgaggcctgtatggcccctttcatcaatatctattcaaatatacaggtgcatatatacttgttaaagctcttatataaaaaagccccaaaatattgaagttcatctgaaatgcaaggtgctttcatcaatgaaccttttcaaacttttctatgattgcagagaagctttttatatacccagcataacttggaaacaggtatctgacctattcttatttagttaacacaagtgtgattaatttgatttctttaattccttattgaatcttatgtgatatgattttctggatttacagaacattagcacatgtaccttgtgcctcccattcaagtgaagttataatttacactgagggtttcaaaattcgactagaagtggagatatattatttatttatgcactgtactgtatttttatattgctgtttaaaacttttaagctgtgcctcacttattaaagcacaaaatgttttacctactccttatttacgacgcaataaaataacatcaatagatttttaggctgaattaatttgaaagcagcaatttgctgttctcaaccattctttcaaggcttttcattgttcaaagttaataaaaaagtaggacaataaagtgaaaaaaaaaaaaaaaaaa

SEQ ID NO: 43 - DNA, 2211 bp, Homo sapiens
ggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaaaaaaaaaaaaaaaaaaaa

SEQ ID NO: 44 - DNA, 2508 bp, Homo sapiens; identical to SEQ ID NO: 24

SEQ ID NO: 45 - DNA, 4175 bp, Homo sapiens
actcggtgcgccttccgcggaccgggcgacccagtgcacggccgccgcgtcactctcggtcccgctgaccccgcgccgagccccggcggctctggccgcggccgcactcagcgccacgcgtcgaaagcgcaggccccgaggacccgccgcactgacagtatgagccgcacagcctacacggtgggagccctgcttctcctcttggggaccctgctgccggctgctgaagggaaaaagaaagggtcccaaggtgccatccccccgccagacaaggcccagcacaatgactcagagcagactcagtcgccccagcagcctggctccaggaaccgggggcggggccaagggcggggcactgccatgcccggggaggaggtgctggagtccagccaagaggccctgcatgtgacggagcgcaaatacctgaagcgagactggtgcaaaacccagccgcttaagcagaccatccacgaggaaggctgcaacagtcgcaccatcatcaaccgcttctgttacggccagtgcaactctttctacatccccaggcacatccggaaggaggaaggttcctttcagtcctgctccttctgcaagcccaagaaattcactaccatgatggtcacactcaactgccctgaactacagccacctaccaagaagaagagagtcacacgtgtgaagcagtgtcgttgcatatccatcgatttggattaagccaaatccaggtgcacccagcatgtcctaggaatgcagccccaggaagtcccagacctaaaacaaccagattcttacttggcttaaacctagaggccagaagaacccccagctgcctcctggcaggagcctgcttgtgcgtagttcgtgtgcatgagtgtggatgggtgcctgtgggtgtttttagacaccagagaaaacacagtctctgctagagagcactccctattttgtaaacatatctgctttaatggggatgtaccagaaacccacctcaccccggctcacatctaaaggggcggggccgtggtctggttctgactttgtgtttttgtgccctcctggggaccagaatctcctttcggaatgaatgttcatggaagaggctcctctgagggcaagagacctgttttagtgctgcattcgacatggaaaagtccttttaacctgtgcttgcatcctcctttcctcctcctcctcacaatccatctcttcttaagttgatagtgactatgtcagtctaatctcttgtttgccaaggttcctaaattaattcacttaaccatgatgcaaatgtttttcattttgtgaagaccctccagactctgggagaggctggtgtgggcaaggacaagcaggatagtggagtgagaaagggagggtggagggtgaggccaaatcaggtccagcaaaagtcagtagggacattgcagaagcttgaaaggccaataccagaacacaggctgatgcttctgagaaagtcttttcctagtatttaacagaacccaagtgaacagaggagaaatgagattgccagaaagtgattaactttggccgttgcaatctgctcaaacctaacaccaaactgaaaacataaatactgaccactcctatgttcggacccaagcaagttagctaaaccaaaccaactcctctgctttgtccctcaggtggaaaagagaggtagtttagaactctctgcataggggtgggaattaatcaaaaacctcagaggctgaaattcctaatacctttcctttatcgtggttatagtcagctcatttccattccactatttcccataatgcttctgagagccactaacttgattgataaagatcctgcctctgctgagtgtacctgacagtagtctaagatgagagagtttagggactactctgttttagcaagagatattttgggggtctttttgttttaactattgtcaggagattgggctaaagagaagacgacgagagtaaggaaataaagggaattgcctctggctagagagtagttaggtgttaatacctggtagagatgtaagggatatgacctccctttctttatgtgctcactgaggatctgaggggaccctgttaggagagcatagcatcatgatgtattagctgttcatctgctactggttggatggacataactattgtaactattcagtatttactggtaggcactgtcctctgattaaacttggcctactggcaatggctacttaggattgatctaagggccaaagtgcagggtgggtgaactttattgtactttggatttggttaacctgttttcttcaagcctgaggttttatatacaaactccctgaatactctttttgccttgtatcttctcagcctcctagccaagtcctatgtaatatggaaaacaaacactgcagacttgagattcagttgccgatcaaggctctggcattcagagaacccttgcaactcgagaagctgtttttatttcgtttttgttttgatccagtgctctcccatctaacaactaaacaggagccatttcaaggcgggagatattttaaacacccaaaatgttgggtctgattttcaaacttttaaactcactactgatgattctcacgctaggcgaatttgtccaaacacatagtgtgtgtgttttgtatacactgtatgaccccaccccaaatctttgtattgtccacattctccaacaataaagcacagagtggatttaattaagcacacaaatgctaaggcagaattttgagggtgggagagaagaaaagggaaagaagctgaaaatgtaaaaccacaccagggaggaaaaatgacattcagaaccagcaaacactgaatttctcttgttgttttaactctgccacaagaatgcaatttcgttaacggagatgacttaagttggcagcagtaatcttcttttaggagcttgtaccacagtcttgcacataagtgcagatttggctcaagtaaagagaatttcctcaacactaacttcactgggataatcagcagcgtaactaccctaaaagcatatcactagccaaagagggaaatatctgttcttcttactgtgcctatattaagactagtacaaatgtggtgtgtcttccaactttcattgaaaatgccatatctataccatattttattcgagtcactgatgatgtaatgatatattttttcattattatagtagaatatttttatggcaagatatttgtggtcttgatcatacctattaaaataatgccaaacaccaaatatgaattttatgatgtacactttgtgcttggcattaaaagaaaaaaacacacatcctggaagtctgtaagttgttttttgttactgtaggtcttcaaagttaagagtgtaagtgaaaaatctggaggagaggataatttccactgtgtggaatgtgaatagttaaatgaaaagttatggttatttaatgtaattattacttcaaatcctttggtcactgtgatttcaagcatgttttctttttctcctttatatgactttctctgagttgggcaaagaagaagctgacacaccgtatgttgttagagtcttttatctggtcaggggaaacaaaatcttgacccagctgaacatgtcttcctgagtcagtgcctgaatctttattttttaaattgaatgttccttaaaggttaacatttctaaagcaatattaagaaagactttaaatgttattttggaagacttacgatgcatgtatacaaacgaatagcagataatgatgactagttcacacataaagtccttttaaggagaaaatctaaaatgaaaagtggataaacagaacatttataagtgatcagttaatgcctaagagtgaaagtagttctattgacattcctcaagatatttaatatcaactgcattatgtattatgtctgcttaaatcatttaaaaacggcaaagaattatatagactatgaggtaccttgctgtgtaggaggatgaaaggggagttgatagtctcataaaactaatttggcttcaagtttcatgaatctgtaactagaatttaattttcaccccaataatgttctatatagcctttgctaaagagcaactaataaattaaacctattctttcaaaaaaaaaaaaaaaaaaaaaaaaaaaaaaaaaaaaaaaaa

SEQ ID NO: 46 - DNA, 1190 bp, Homo sapiens; identical to SEQ ID NO: 27

SEQ ID NO: 47 - DNA, 1543 bp, Homo sapiens
gctctcattaccttctgcccatcacttaataaatagccagccaattcatcaacattctggtacactgttggagagatgagacagtcacaccagctgcccctagtggggctcttactgttttcttttattccaagccaactatgcgagatttgtgaggtaagtgaagaaaactacatccgcctaaaacctctgttgaatacaatgatccagtcaaactataacaggggaaccagcgctgtcaatgttgtgttgtccctcaaacttgttggaatccagatccaaaccctgatgcaaaagatgatccaacaaatcaaatacaatgtgaaaagcagattgtcagatgtaagctcgggagagcttgccttgattatactggctttgggagtatgtcgtaacgctgaggaaaacttaatatatgattaccacctgatcgacaagctagaaaataaattccaagcagaaattgaaaatatggaagcacacaatggcactcccctgactaactactaccagctcagcctggacgttttggccttgtgtctgttcaatgggaactactcaaccgccgaagttgtcaaccacttcactcctgaaaataaaaactattattttggtagccagttctcagtagatactggtgcaatggctgtcctggctctgacctgtgtgaagaagagtctaataaatgggcagatcaaagcagatgaaggcagtttaaagaacatcagtatttatacaaagtcactggtagaaaagattctgtctgagaaaaaagaaaatggtctcattggaaacacatttagcacaggagaagccatgcaggccctctttgtatcatcagactattataatgaaaatgactggaattgccaacaaactctgaatacagtgctcacggaaatttctcaaggagcattcagcaatccaaacgctgcagcccaggtcttacctgccctgatgggaaagaccttcttggatattaacaaagactcttcttgcgtctctgcttcaggtaacttcaacatctccgctgatgagcctataactgtgacacctcctgactcacaatcatatatctccgtcaattactctgtgagaatcaatgaaacatatttcaccaatgtcactgtgctaaatggttctgtcttcctcagtgtgatggagaaagcccagaaaatgaatgatactatatttggtttcacaatggaggagcgctcatgggggccctatatcacctgtattcagggcctatgtgccaacaataatgacagaacctactgggaacttctgagtggaggcgaaccactgagccaaggagctggtagttacgttgtccgcaatggagaaaacttggaggttcgctggagcaaatactaataagcccaaactttcctcagctgcataaaatccatttgcagtggagttccatgtttattgtccttatgccttcttcttcatttatcccagtacgagcaggagagttaataacctccccttctctctctacatgttcaataaaagttgttgaaagattaacaactgt

SEQ ID NO: 48 - DNA, 4266 bp, Homo sapiens
agagtttcagttttggcagcagcgtccagtgccctgccagtagctcctagagaggcaggggttaccaactggccagcaggctgtgtccctgaagtcagatcaacgggagagaaggaagtggctaaaacattgcacaggagaagtcggcctgagtggtgcggcgctcgggacccaccagcaatgctgctcttcgtgctcacctgcctgctggcggtcttcccagccatctccacgaagagtcccatatttggtcccgaggaggtgaatagtgtggaaggtaactcagtgtccatcacgtgctactacccacccacctctgtcaaccggcacacccggaagtactggtgccggcagggagctagaggtggctgcataaccctcatctcctcggagggctacgtctccagcaaatatgcaggcagggctaacctcaccaacttcccggagaacggcacatttgtggtgaacattgcccagctgagccaggatgactccgggcgctacaagtgtggcctgggcatcaatagccgaggcctgtcctttgatgtcagcctggaggtcagccagggtcctgggctcctaaatgacactaaagtctacacagtggacctgggcagaacggtgaccatcaactgccctttcaagactgagaatgctcaaaagaggaagtccttgtacaagcagataggcctgtaccctgtgctggtcatcgactccagtggttatgtaaatcccaactatacaggaagaatacgccttgatattcagggtactggccagttactgttcagcgttgtcatcaaccaactcaggctcagcgatgctgggcagtatctctgccaggctggggatgattccaatagtaataagaagaatgctgacctccaagtgctaaagcccgagcccgagctggtttatgaagacctgaggggctcagtgaccttccactgtgccctgggccctgaggtggcaaacgtggccaaatttctgtgccgacagagcagtggggaaaactgtgacgtggtcgtcaacaccctggggaagagggccccagcctttgagggcaggatcctgctcaacccccaggacaaggatggctcattcagtgtggtgatcacaggcctgaggaaggaggatgcagggcgctacctgtgtggagcccattcggatggtcagctgcaggaaggctcgcctatccaggcctggcaactcttcgtcaatgaggagtccacgattccccgcagccccactgtggtgaagggggtggcaggaggctctgtggccgtgctctgcccctacaaccgtaaggaaagcaaaagcatcaagtactggtgtctctgggaaggggcccagaatggccgctgccccctgctggtggacagcgaggggtgggttaaggcccagtacgagggccgcctctccctgctggaggagccaggcaacggcaccttcactgtcatcctcaaccagctcaccagccgggacgccggcttctactggtgtctgaccaacggcgatactctctggaggaccaccgtggagatcaagattatcgaaggagaaccaaacctcaaggtaccagggaatgtcacggctgtgctgggagagactctcaaggtcccctgtcactttccatgcaaattctcctcgtacgagaaatactggtgcaagtggaataacacgggctgccaggccctgcccagccaagacgaaggccccagcaaggccttcgtgaactgtgacgagaacagccggcttgtctccctgaccctgaacctggtgaccagggctgatgagggctggtactggtgtggagtgaagcagggccacttctatggagagactgcagccgtctatgtggcagttgaagagaggaaggcagcggggtcccgcgatgtcagcctagcgaaggcagacgctgctcctgatgagaaggtgctagactctggttttcgggagattgagaacaaagccattcaggatcccaggctttttgcagaggaaaaggcggtggcagatacaagagatcaagccgatgggagcagagcatctgtggattccggcagctctgaggaacaaggtggaagctccagagcgctggtctccaccctggtgcccctgggcctggtgctggcagtgggagccgtggctgtgggggtggccagagcccggcacaggaagaacgtcgaccgagtttcaatcagaagctacaggacagacattagcatgtcagacttcgagaactccagggaatttggagccaatgacaacatgggagcctcttcgatcactcaggagacatccctcggaggaaaagaagagtttgttgccaccactgagagcaccacagagaccaaagaacccaagaaggcaaaaaggtcatccaaggaggaagccgagatggcctacaaagacttcctgctccagtccagcaccgtggccgccgaggcccaggacggcccccaggaagcctagacggtgtcgccgcctgctccctgcacccatgacaatcaccttcagaatcatgtcgatcctggggccctcagctcctggggaccccactccctgctctaacacctgcctaggtttttcctactgtcctcagaggcgtgctggtcccctcctcagtgacatcaaagcctggcctaattgttcctattggggatgagggtggcatgaggaggtcccacttgcaacttctttctgttgagagaacctcaggtacggagaagaatagaggtcctcatgggtcccttgaaggaagagggaccagggtgggagagctgattgcagaaaggagagacgtgcagcgcccctctgcacccttatcatgggatgtcaacagaatttttccctccactccatccctccctcccgtccttcccctcttcttctttccttccatcaaaagatgtatttgaattcatactagaattcaggtgctttgctagatgctgtgacaggtatgccaccaacactgctcacagcctttctgaggacaccagtgaaagaagccacagctcttcttggcgtatttatactcactgagtcttaacttttcaccaggggtgctcacctctgcccctattgggagaggtcataaaatgtctcgagtcctaaggccttaggggtcatgtatgatgagcatacacacaggtaattataaacccacattcttaccatttcacacataagaaaattgaggtttggaagagtgaagcgtttttctttttcttttttttttttgagacggagtctctcactgtcgcccaggctggagtgcagtggcgcaatctcggctcactgcaacctccgcctcccaggttgacaccattctcctgcctcaccctcccaagtagctgggactacaggcgcctgccagcacgcctggctaattttttgtatttttagtagagacagggtttcaccgtgttagccaggatggtctcgatctcctgacctcgtgatccgcctgcctctgcctcccaaagtgctgggattacaggcgtgagccaccgcgtccggcctctttttttcttttcttttttttgagacaaagtctcactgtgtcacccagactggaatgcagtgacacaatctcggctcactgaaacctctgccttccaggttcaagctattctcatgcctcagcctctcaagtagctgggactacagatgtgggccaccatgtctggctaattttttttttttttttttttttttgtagagacagggtttcgccatgttgacgagactggtctcgaactcctggcctcaagtgatctgccgcctcagcttctcaaagtactgggattatataggcatgagccactgagcctggccctgaagcgtttttctcaaaggccctcagtgagataaattagatttggcatctcctgtcctgggccagggatctctctacaagagcccctgcccctctgttggaggcacagttttagaataaggaggaggagggagaagagaaaatgtaaaggagggagatctttcccaggccgcaccatttctgtcactcacatggacccaagataaaagaatggccaaaccctcacaacccctgatgtttgaagagttccaagttgaagggaaacaaagaagtgtttgatggtgccagagaggggctgctctccagaaagctaaaatttaatttcttttttcctctgagttctgtacttcaaccagcctacaagctggcacttgctaacaaatcagaaatatgacaattaatgattaaagactgtgattgcc

SEQ ID NO: 49 - DNA, 3307 bp, Homo sapiens; identical to SEQ ID NO: 42

SEQ ID NO: 50 - DNA, 6216 bp, Homo sapiens
gcgggcaaggcgggcggagcgcactggaactcaagggggcgcacagcggcgcgctcgcaccgctcggctccgcgcggctctaggaggtggcggcggtggcggtggcggcggtggcggcggcggcggcggcggggcgcagggctgagcgagcgtccgggttccggggctccggggaaggcggttgcagctcctgagtgcagcgcggcttcctgccactgtcccggcccggccacctctctgtcatggctctggcggacagcacacgtggattacccaacgggggcggcggcgggggcggcagtggctcctcgtcgtcctccgcggagccaccgctcttccccgacatcgtggagctgaacgtggggggccaggtgtacgtgacccggcgctgcacggtggtgtcggtgcccgactcgctgctctggcgcatgttcacgcagcagcagccgcaggagctggcccgggacagcaaaggccgcttctttctggaccgggacggcttcctcttccgctacatcctggattacctgcgggacttgcagctcgtgctgcccgactacttccccgagcgcagccggctgcagcgcgaggccgagtacttcgagctgccagagctcgtgcgccgcctcggggcgccccagcagcccggcccggggccgccgccctcgcggcgcggggtgcacaaggagggctcgctgggtgacgagctgctgccgcttggctactcggagcccgaacagcaggagggcgcctctgccggggcgccgtcgcccacgctggagctggctagccgcagtccgtccgggggcgcggcgggcccgctgctcacgccgtcccagtcgctggacggcagccggcgctcgggctacatcaccatcggctaccgcggctcctacaccatcgggcgggacgcgcaggcggacgccaagttccggcgagtggcgcgcatcaccgtttgcggaaagacgtcgctggccaaggaggtgtttggggacaccctgaacgaaagccgggaccccgaccgtcccccggagcgctacacctcgcgctattacctcaagttcaacttcctggagcaggccttcgacaagctgtccgagtcgggcttccacatggtggcgtgcagctccacgggcacctgcgcctttgccagcagcaccgaccagagcgaggacaagatctggaccagctacaccgagtacgtcttctgcagggagtgagctccccagaccccctcgccactccagcgcccagtccttctcctgcccgagagatgattacagagcctcttgtcccacctttgtcccctggctgctgccctcccattctccccctccagtagtagctgggtgagacctgtccgcccaccttccctccactacagaacctgcagccgcaaatcctctgggctgcttcgtcttctttggacctcctgaaccgagagaacccagaggaacccccaccccacccccacctaccactccatgctttctctactccctgcctcaaaccacccctcccccagatggtacttcagtttggatctattgggggagtgtggccacagaccgggggatgattgaattgttcagaacctgattggaccgtgtccaatgtgcggaagatttccttgaaatcttctcaagctcttatgactcactgggggtttaagagatcaggattggttccactgtctggggttagtgttttacaaggtcattacacagtctttttgacctcttttgaaggtagagttttagaaggctggatggaagattctgagcctggaattaggaccccatggaggcagttcagtaactaaactaataaagttttgaaaagttacacgtaaagtagaagaatctagtgcgtgggacagtaaaggatcctttctcgtacagaataaaaggtctcagcctgtagcttaaacttatagaaagtgatccgcctgcctgcagaggcgcccttttcagctgctgctcgccagaagcccttgattccactggttgacatggcagcagttactggcaagagggagaaaggacgctgccgcctaagagtgcaaggctgctcaggtctccaagcgccgtaggaggtcacctggcagtgactgtagggagctgggtcatagtgcacgtcgtgggtattaggaaagcctgtattctttcaatgaatgtcagtaggaccttcctttagctgtaagacttggtgggcggggtggggtggggagggaggaaagggtaggaagggtgggaagggagaagcagacatagtcatttatgatttgaaagttggaagtttgtaccatctgtttgagtatatgcacatttaaaaaatatcatatagtaaatgcaaacatgccaagtattttataaagattaataacagacctactcttacctggcagtttacttaacttactgttttgagtcctaaacttagagttgttaatgcttatatataatctaaccaaagagttacccagtagggttttagtttttgaacttttattttcttgttgattataaatcctgattttggaatctattgcgcaaaagaagtttcattttggttacttagacctaagatcacttattaaaaatccttattttctccaagcccagcaaacgttgacttctgggcaaacctgaaaacctgaaaatgccactttcatgcagtttgtttgaagttaagtggaatcctttcaaatgacgagctgcagagaactcagcaccaagggctgcctatctgtagatagctgtaaaatggaatatttttaaatgaaggcaaataagtacttaaaagtgagctgagcaataaaatggtccaataataggtaaatgcaacagaaacagaaggagacctggttgccttatgcctttactcttacatggaataaattcccaatgcatatcctatgtaaaccataagtgaagggaaataaacctcgtcatgctccatgctgtgaggtgtcctttggatattctgtgatgacagagaagcctattttgttttgttttcagcatctttctctgatgtacgtttttaaggattttgtaagagctgttttcagtgtttaaattagtgctatttttccttgtttttaaaaatgaatctcgtactgtatcttactatgtccatacagatgttacaaatcgacagttttattcttagactcatgtgatccaagctgtatataccatatataaacattttacatgaatcatttagttttttaattcatttactaatgctataaaatttcctatattaccccagtaatttgcatcagctggtttatatactaaagcaacatgttttgatgagtttcttacatccttatcgaggaattgggttaggaaaaaatacataattgtaaaactgagtttgctgtattatactttttttcttgagtattagttgtattactaatcatatgttgattaactgtctacttaaagtcaaggtacctgtatttttaatccactaatttttttttagttgggaaatagatttcaagtcttttattagactaacattttttgagaagtaaaattgactttatatacaaagcctgtaattttaggcgaaatggaagcagaaatctaggaagttgtgcttgcttgtatggtctcagactaagtaatgcatcagaattcatctgtttgaagcctgaaataatttaggactctgattcactgaccaaaagtcagtgttgcagagatttctctaccccgtatggtattttgttagattgttcaacaggaagcacatgattgagaacatcttgggacagaccaaaaccactgacagatggcaaggctcggcgattctgatttcccttctcaaatctgctcaactccaagagtcttgagaaactgctaaaattttgcctctgtcactcaagtcttacaaatgttatcttgtaaacctttgaggtgaactattccactgtcttgtacataggcatcttattcactgcaccctgtcacacccagcaccccccgccccgcacattatttgaaagactgggaatttaatggttagggacagtaaatctacttctttttccagggacgactgtcccctctaaagttaaagtcaatacaagaaaactgtctatttttagcctaaagtaaaggctgtgaagaaaattcattttacattgggtagacagtaaaaaacaagtaaaataacttgacatgagcacctttagatcccttcccctccatgggctttgggccacagaatgaacctttgaggcctgtaaagtggattgtaatttcctataagctgtaatagtggaggtattgtgggttcatttgagtaagccctccaaagataccattcaaataacctgggagaatgtcataaattattcagataattatcactgcatgaatctgattcagaggcatgcatttacatatgttgccctaattaccatttgatgatcataaatacaagtgaatgacattggacttttagtaacaaacttaatttttaaaaaagtgtagacaatggtggttaaaaaaaaaaaaaacaggtgccaggttctgtgtgtttgcaccaagtaattgacatgttttttgtttaatacatgtggaccatgaacagtattcattctactttttcaaatgatatgctgtagaaaatattccttgaagatgtgagatttaaaaatttttccctttcaatgttgttttaattgtatttcttacttggtttttttgattgatagcacagtgataaatcataatactagacaaaattgtcttctctttcaaaccagagccatatatatgtctgtatatatgggacctactgcttctctgaggaaatgcataatctgttaatatcagacaaaatgagcaattggcagtgctcataatatattccaatttttattggaattttcgatggaatgttatttcaataaagccatgtaaggtgaaactttgataactttttactcttcaagttagggtaaattctgatccaatattcaattcatttgtgtactcccacatgcaaaatgctaaattacaatgcagacattaagaaaaagtattgactggaggggttgaattccttgagaatttattttatagtctaaatcacaaatactttactcaatttagtttttaaaatagtaaactgaatatttttgttgtaagcctatcagagtcaatccttcgtttggaattgttttcctgtttttccttactataaatcatttaaaaactgaattcattttcttagatggcataagtctgtctcttgagaaataagtaaaatactcctattttcagtatctgtagcacctgaaataggtctttgtatagccagaaacaagttatgttgaagttagcttttctttgtcaacagttttggacaataaaaatctgaaagtattaacacttgattttctactggggcccttcaaacttggttggaagaaattcaaccagaatatctacattagagtataatcatgtgtggtaggaagatggactagttaatcaagatttgttgtcacttaaattttttgtgatttttttccaagccagtttttttaaattctaaatgtgttttgaggtatgggtacattaattgtaatgtaaactattatacaactgtttttgcgactttataggcaggtaaattttgctattactattgaatacaaatgacaattcatttatgaccactcaaacagcgttagtaaccatttagtgacaaaggattaaaacatccatctggatgttaattttgaagatgtaaattatatgttgtttaaatttttccaggcatctgaaaaccttatctgctagacaatgtaagattcacacagagttatctgggattctgattttttaaatagtacatatcattaaaccattttctctaaatgtaagaagagcagaaaaaatcttataagattatcagatttttctaatgacacagaaatgtaagaaaaaaatccctttatattgaaaaaagatgcagtcaaagtcttttcagacatgcccaaactttgagaattccttcaaccatctaatgctataaagatttttgttcttcctgttcacaaccagttgtataacagaaatactagctactgttttccttcctgtgtgtgaagtaatgaatcattgattatgtgacttgttatgtattcaattaaacactaaagaataaaacattcactccttt

SEQ ID NO: 51 - DNA, 2135 bp, Homo sapiens
aagtcagggtgggacgtgggcgcggggagacaggtggtggctacgacggcgaagggagctgagactgtccaggcagccaggttaggccaggaggaccatgtgaatggggccagagggctcccgggctgggcagggaccatgggctgtggctgcagctcacacccggaagatgactggatggaaaacatcgatgtgtgtgagaactgccattatcccatagtcccactggatggcaagggcacgctgctcatccgaaatggctctgaggtgcgggacccactggttacctacgaaggctccaatccgccggcttccccactgcaagacaacctggttatcgctctgcacagctatgagccctctcacgacggagatctgggctttgagaagggggaacagctccgcatcctggagcagagcggcgagtggtggaaggcgcagtccctgaccacgggccaggaaggcttcatccccttcaattttgtggccaaagcgaacagcctggagcccgaaccctggttcttcaagaacctgagccgcaaggacgcggagcggcagctcctggcgcccgggaacactcacggctccttcctcatccgggagagcgagagcaccgcgggatcgttttcactgtcggtccgggacttcgaccagaaccagggagaggtggtgaaacattacaagatccgtaatctggacaacggtggcttctacatctcccctcgaatcacttttcccggcctgcatgaactggtccgccattacaccaatgcttcagatgggctgtgcacacggttgagccgcccctgccagacccagaagccccagaagccgtggtgggaggacgagtgggaggttcccagggagacgctgaagctggtggagcggctgggggctggacagttcggggaggtgtggatggggtactacaacgggcacacgaaggtggcggtgaagagcctgaagcagggcagcatgtccccggacgccttcctggccgaggccaacctcatgaagcagctgcaacaccagcggctggttcggctctacgctgtggtcacccaggagcccatctacatcatcactgaatacatggagaatgggagtctagtggattttctcaagaccccttcaggcatcaagttgaccatcaacaaactcctggacatggcagcccaaattgcagaaggcatggcattcattgaagagcggaattatattcatcgtgaccttcgggctgccaacattctggtgtctgacaccctgagctgcaagattgcagactttggcctagcacgcctcattgaggacaacgagtacacagccagggagggggccaagtttcccattaagtggacagcgccagaagccattaactacgggacattcaccatcaagtcagatgtgtggtcttttgggatcctgctgacggaaattgtcacccacggccgcatcccttacccagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttgagaggccttgagaggccctggggttctccccctttctctccagcctgacttggggagatggagttcttgtgccatagtcacatggcctatgcacatatggactctgcacatgaatcccacccacatgtgacacatatgcaccttgtgtctgtacacgtgtcctgtagttgcgtggactctgcacatgtcttgtacatgtgtagcctgtgcatgtatgtcttggacactgtacaaggtacccctttctggctctcccatttcctgagaccacagagagaggggagaagcctgggattgacagaagcttctgcccacctacttttctttcctcagatcatccagaagttcctcaagggccaggactttatctaatacctctgtgtgctcctccttggtgcctggcctggcacacatcaggagttcaataaatgtctgttgatgactgttgtaaaaaaaaaaaaaaaaaaa

SEQ ID NO: 52 - DNA, 2242 bp, Homo sapiens
gaatctcgacccttgaatggagttacacgaacggccagatgaaagaaggaaggcccggacctccactcagggccgactaggggactggcggagggtgcacgctgatggatttactcaccgggtgcttggagctccagcagctggctggagcccgcgatgacgtcacggactcgggtcacatggccaagtccgccccgccccctccccgtccccgccgctgcagcggtcgccttcggagcgaagggtaccgacccggcagaagctcggagctctcggggtatcgaggaggcaggcccgcgggcgcacgggcgagcgggccgggagccggagcggcggaggagccggcagcagcggcgcggcgggctccaggcgaggcggtcgacgctcctgaaaacttgcgcgcgcgctcgcgccactgcgcccggagcgatgaagatggtcgcgccctggacgcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctggaacactgtgatagattaactgtagaattcttcctgtacgattggggatataatgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagttgtttgcaattaaaacaaggtttgcccacatccaagaaaaa

SEQ ID NO: 53 - DNA, 3600 bp, Homo sapiens
gaagagactcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtatgacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagtgagactccgtcaaaaaaaaaaaaaagtctatgtggtcagtcactactcttgctgcagttatgaaaagaatgaggccaagtctgatgaaaataaacttattttgaaaaca

SEQ ID NO: 54 - DNA, 1336 bp, Homo sapiens
ggggcttgcagagccggcgccggaggagacgcacgcagctgactttgtcttctccgcacgactgttacagaggtctccagagccttctctctcctgtgcaaaatggcaactcttaaggaaaaactcattgcaccagttgcggaagaagaggcaacagttccaaacaataagatcactgtagtgggtgttggacaagttggtatggcgtgtgctatcagcattctgggaaagtctctggctgatgaacttgctcttgtggatgttttggaagataagcttaaaggagaaatgatggatctgcagcatgggagcttatttcttcagacacctaaaattgtggcagataaagattattctgtgaccgccaattctaagattgtagtggtaactgcaggagtccgtcagcaagaaggggagagtcggctcaatctggtgcagagaaatgttaatgtcttcaaattcattattcctcagatcgtcaagtacagtcctgattgcatcataattgtggtttccaacccagtggacattcttacgtatgttacctggaaactaagtggattacccaaacaccgcgtgattggaagtggatgtaatctggattctgctagatttcgctaccttatggctgaaaaacttggcattcatcccagcagctgccatggatggattttgggggaacatggcgactcaagtgtggctgtgtggagtggtgtgaatgtggcaggtgtttctctccaggaattgaatccagaaatgggaactgacaatgatagtgaaaattggaaggaagtgcataagatggtggttgaaagtgcctatgaagtcatcaagctaaaaggatataccaactgggctattggattaagtgtggctgatcttattgaatccatgttgaaaaatctatccaggattcatcccgtgtcaacaatggtaaaggggatgtatggcattgagaatgaagtcttcctgagccttccatgtatcctcaatgcccggggattaaccagcgttatcaaccagaagctaaaggatgatgaggttgctcagctcaagaaaagtgcagataccctgtgggacatccagaaggacctaaaagacctgtgactagtgagctctaggctgtagaaatttaaaaactacaatgtgattaactcgagcctttagttttcatccatgtacatggatcacagtttgctttgatcttcttcaatatgtgaatttgggctcacagaatcaaagcctatgcttggtttaatgcttgcaatctgagctcttgaacaaataaaattaactattgtagtgcgaaaaaaaaaaaaaaaaaaaaaaaaaaaaa

SEQ ID NO: 55 - DNA, 656 bp, Homo sapiens
gggaacacatccaagcttaagacggtgaggtcagcttcacattctcaggaactctccttctttgggtctggctgaagttgaggatctcttactctctaggccacggaattaacccgagcaggcatggaggcctctgctctcacctcatcagcagtgaccagtgtggccaaagtggtcagggtggcctctggctctgccgtagttttgcccctggccaggattgctacagttgtgattggaggagttgtggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggagcaactggactctccggattgaccaagttcatcctgggctccattgggtctgccattgcggctgtcattgcgaggttctactagctccctgcccctcgccctgcagagaagagaaccatgccaggggagaaggcacccagccatcctgacccagcgaggagccaactatcccaaatatacctggggtgaaatataccaaattctgcatctccagaggaaaataagaaataaagatgaattgttgcaactcttcaaaa

SEQ ID NO: 56 - DNA, 4869 bp, Homo sapiens
cattctgctggctgcgcggtggcggcggctgtgtgtgcgccgcgccttgccgccccccctggccccccgagcccggggcgcgcgctcccgcccgggccgtccgggccccgcggcgccgcggcccgaggccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggctacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagaagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggaggtttgacattcacctgcctcggctcacctcttcctccaagccccgccccctctgccccacgtgccggccctcctggtgctctatccactgcagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccgcccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggcttttgtcctcctgggtcagggagaacgcggggaccccagaaaggtcagccttcctgaggatgggcaacccccaggtctgcagctccaggtacatatcacgcgcacagcctggcagcctggccctcctggtgcccactcccgccagcccctgcctcgaggactgatactgcagtgactgccgtcagctccgactgccgctgagaagggttgatcctgcatctgggtttgtttacagcaattcctggactcgggggtattttggtcacagggtggttttggtttagggggtttgtttgttgggttgttttttgttttttggttttttttaatgacaatgaagtgacactttgacatttcctaccttttgaggacttgatccttctccaggaagaaggtgctttctgcttactgacttaggcaatacaccaagggcgagattttatatgcacatttctggatttttttatacggttttcattgacactcttccctcctcccacctgccaccaggcctcaccaaagcccactgccatggggccatctgggccattcagagactggagtgagatttgggtgtggagggggaggcgccaaggtggaggagcttcccactccaggactgttgatgaaagggacagattgaggaggaagtgggctctgaggctgcagggctggaagtccttgcccacttcccactctcctgccccaatctatctagtacttcccaggcaaataggcccctttgaggctcctgagtgccctcagatggtcaaaacccagttttccctctgggagcctaaaccaggctgcatcggaggccaggacccggatcattcactgtgataccctgccctccagagggtgcgctcagagacacgggcaagcatgcctcttcccttccctggagagaaagtgtgtgatttctctcccacctccttccccccaccagacctttgctgggcctaaaggtcttggccatggggacgccctcagtctagggatctggccacagactccctcctgtgaaccaacacagacacccaagcagagcaatcagttagtgaattgaatggaaataaacgctttagttataatatga

SEQ ID NO: 57 - DNA, 10128 bp, Homo sapiens
ggcccccgccgggtgctgagcgcccgccaccgccctcttggccttttcccggtccccgccgcgcgcctgctgctgtccccgtgcccgaggactgggaggatggggctgagccgcttgcctgacttttgatccgaccagtaatcactttgcccgtgtggcgcgtggcccgttgcctgaggcttcctggcgcgtggggctgtttggtcccctccggagtgcggtgaggcgggccgagccgggactgcctgggtttggggataacgttcccatctccacccctgttgcagcaagggaaattgaggctgagggaactgggcccagggacggcgagccgtggctgcctctccagtccgggccccgaagggctgctcgtggatgaaccagactgattttaaggggtgaagagggtgcgtttcaatcagatgcttctggaacgtcgaaattgtcttctttggaaagaaccatcccctctttgggcttcagaggcccaaattgaggcgcaatgatgagaggatgtggtggtctactctgatgtcaatcttgagggctaggtctttctggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataagactttgaaatactcgtgggatatgaagtggaggtgcctagagggttgaagataatgaggacagatgaagaaatgtttgattgtgccatacttacagttgctgattttcaaggtccagcatgtctggcttgcacctagtaaagcagggccgagacagaaagaaaatagattctcaacgagatttcactgtggcttctccagcagaatttgttactcgctttgggggaaataaagtgattgagaaggttcttattgctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcagatcactatgtgccagtgcctggaggaccaaacaacaacaactatgcaaatgtggaattaattcttgatattgctaaaaggatcccagtacaagcagtgtgggctggctggggtcatgcttctgagaatcccaaactaccggaacttctcttgaaaaatggcattgccttcatgggtcctccaagccaggccatgtgggctttaggggataagattgcatcttccatagtggctcaaactgcaggtatcccaactcttccctggagcggcagtggtcttcgtgtggactggcaggaaaatgatttttcaaaacgtatcttaaatgttccccaggagctatatgaaaaaggttatgtgaaagatgtggatgatgggctacaggcagctgaggaagttggatatccagtaatgatcaaggcctcagagggaggaggagggaagggaattagaaaagtcaacaatgcagatgacttccctaatctcttcagacaggttcaagctgaagttcctggatctcccatatttgtgatgagactagccaaacaatctcgtcatctggaggtgcagatcttagcggaccaatatggcaatgctatctctttgtttggtcgtgattgctctgtacaacgcaggcatcagaagattattgaagaagcacctgctactattgctactccagcagtatttgaacacatggaacagtgtgcggtgaaacttgccaaaatggtgggttatgtgagtgctgggactgtggaatacctgtacagccaggatggcagcttctactttctggaattgaatcctcggctgcaggtagagcacccttgtacagagatggtggctgatgtcaatctccctgcagcacagctccagattgccatggggattcctctatatagaatcaaggatatccgtatgatgtatggggtatctccctggggtgattctcccattgattttgaagattctgcacacgttccttgtccaaggggccatgttattgctgctcggatcactagtgaaaatccagatgagggttttaagcccagctcaggaacagttcaggagctaaatttccgcagcaataagaatgtttggggatatttcagtgttgctgctgcagggggacttcatgaatttgctgattctcagtttggtcactgcttttcttggggagaaaacagagaagaggcaatttcaaacatggtggtggctttgaaggagctgtctattcggggtgactttcgaactacagttgaatacctgatcaaattgttagagactgaaagctttcagatgaacagaattgatactggctggctggacagactgatagcagaaaaagtacaggctgagcgacctgacaccatgttgggggttgtgtgtggtgccctccacgtggcagatgtgagcctgcggaatagcgtctctaacttccttcactccttagaaaggggtcaagtccttcctgctcatacacttctgaatacagtagatgttgaacttatctatgagggagtcaagtatgtacttaaggtgactcgacagtcccccaactcctatgtggtgatcatgaatggctcatgtgtagaagtagatgtacatcggctgagtgacggtggactgctcttgtcctatgatggcagcagttatactacgtatatgaaagaggaagtggatagatatcgcatcacaattggcaataaaacctgtgtgtttgagaaggaaaatgacccatcggtgatgcgctcaccttctgctgggaagttaatccagtacattgtagaagatggaggtcatgtgtttgccggccagtgctatgctgagattgaggtaatgaagatggtaatgaccttaacagctgtggagtctggctgtatccattacgtcaagcgacctggagcagctcttgaccctggctgtgtactagccaaaatgcaactggacaaccccagcaaggttcagcaggctgaacttcacacaggtagtctgccacggatccagagcacggcactcagaggcgagaaactccatcgagtgttccattatgtcctggataatctggtcaatgtaatgaatggatactgccttccagatcctttctttagcagcaaggtaaaagactgggtagagcgattgatgaaaaccctcagagatccctccctgcctctcctagaattgcaagatattatgaccagtgtgtctggccgcattccccccaatgtggagaagtctatcaagaaggaaatggctcagtatgctagcaacatcacatcagtcctctgtcagtttcccagccagcagattgcaaacatcctagatagccatgcagctacattgaaccggaaatctgaacgggaagtcttctttatgaatactcagagcattgttcagctggtacagaggtaccgaagtggcatccgaggccacatgaaggctgtggtgatggatctgctccggcagtacctgcgagtagagacacaattccagaatggtcactatgacaaatgtgtattcgccctccgagaagagaataaaagtgacatgaacactgtactgaactacatcttctctcacgctcaagtcaccaagaagaatcttctggtcacaatgcttattgatcagttgtgtggccgggaccctactctcactgatgagctgctgaatattctcacagagctaactcaactcagtaagaccaccaatgccaaagtagcacttcgagcacgccaggttcttattgcctcccatttgccatcatatgagcttcgccataaccaagtagagtctatcttcctatcagctattgacatgtatggacatcaattttgcattgagaacctgcagaaactcatcctatcagaaacatctatttttgatgtcctaccaaacttcttctatcacagcaaccaagtagtgaggatggcagctctggaggtgtatgttcgaagggcttatattgcctatgaacttaacagcgtacaacaccgccagcttaaggacaacacctgtgtggtggaattccagttcatgctgcccacatctcatccaaacagagggaacatccctacgctaaacagaatgtccttctcctccaacctcaaccactatggcatgacccatgtagctagtgtcagcgatgtactgttggacaactcattcactccaccttgtcagcggatgggcggaatggtctcttttcggacttttgaagattttgtcaggatctttgatgaagtgatgggctgcttctctgactccccaccccagagtcccacattccctgaggcaggtcacacgtctctttatgatgaggataaggttcccagggatgaaccaattcacattctcaatgtggctatcaagactgactgtgatattgaggatgacaggctggcagctatgttcagagaatttacccagcaaaataaagctaccctggttgaccatgggatccggcgccttactttcctggttgcacaaaaggatttcagaaagcaggtcaactatgaggtggatcggagatttcatagagaattccctaaattttttacattccgagcaagggataagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggaagcttcttttgaatatctgcaaaatgaaggggagcggctactcctggaagccatggatgagttggaagttgcttttaacaatacaaatgtccgcactgactgtaaccacatcttcctcaactttgtgcccacggttatcatggacccatcaaagattgaggaatccgtgcggagcatggtaatgcggtatggaagtcgcctgtggaaattgcgcgtcctccaggcagaactgaaaatcaacattcgcctgacgccaactggaaaagcaattcccatccgcctcttcctgacaaacgagtctggctattacttggatatcagcctatacaaggaagtgactgactccaggacagcacagatcatgtttcaggcatatggagacaaacagggaccactgcatggaatgttaatcaatactccatatgtgaccaaagacctgctgcaatcaaagaggttccaggcacaatccttagggacaacatacatatatgatatcccagagatgtttcggcagtccctgatcaaactctgggagtctatgtccactcaagcatttcttccatctccccctctgccttctgacatgctgacttacactgaactggtactggatgatcaaggtcagctggtccacatgaacaggcttccaggaggaaatgagattggcatggtagcttggaaaatgacctttaaaagtcctgaatatccagaaggccgagatatcattgttattggcaatgacatcacataccgaattgggtcctttgggcctcaagaggatttgttatttctcagagcttccgaacttgctagggcagaaggtattccacgcatctatgtatcagccaacagtggagcaagaatcggactggcagaagaaattcgccatatgtttcatgtggcctgggtagatcctgaggatccttacaagggatacaggtatttatatctgactcctcaagattataagagagtcagtgctctcaactctgtccattgtgaacacgtggaagatgaaggagaatccaggtacaagataacagatattattgggaaagaagagggaattggacccgagaaccttcgaggttctggaatgattgctggagaatcctcattggcctataatgagatcattaccatcagcctggtgacgtgccgggccattgggattggggcttaccttgtccggctgggacagagaaccatccaggttgagaattctcacttaattctaacaggagctggagccctcaacaaagtcctcgggcgggaagtgtacacctccaataaccagctggggggcatccagattatgcacaacaatggggtgacccactgcactgtgtgtgatgactttgaaggggttttcactgtcctgcactggctgtcttacatgcccaagagcgtgcacagttcagttcctcttctgaactcaaaggatcctatagacagaatcatcgagtttgttcccacaaagaccccatacgatcctcgatggatgctagcaggccgtcctcacccaacccaaaaaggtcagtggttgagtggcttttttgactatggatctttctcagagattatgcagccctgggcacagactgtggtggttggtagagccaggctaggaggaatacctgtgggagttgttgctgtagaaacccgaacagtagaactaagtatcccagctgatccagcaaacctggattctgaagccaagataatccagcaggctggccaggtttggttcccagattctgcgtttaagacgtatcaggccatcaaggacttcaaccgggaagggctgcctctgatggtctttgccaactggagaggcttctctggtggaatgaaagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggggatctgttctggagccagaagggacagtagaaatcaaattccgcagaaaggatctggtgaaaaccatgcgtcgggtggacccagtctacatccacttggctgagcgattggggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgatatcctggattggaaaacatcccgtaccttcttctactggcggctgaggcgtcttctgctggaggacctggtcaagaagaaaatccacaatgccaaccctgagctgactgatggccagattcaagccatgttaaggcgctggtttgtggaagtggaaggaacagtgaaggcttatgtttgggacaataataaggatctggcggagtggctagagaaacagctgacagaggaggatggtgttcactcggtaatagaggaaaacatcaaatgcatcagcagagactacgtcctcaagcaaatccgcagcttggtccaggccaatccagaggttgccatggattccatcatccatatgacgcagcacatatcacccactcagcgagcagaagtcatacggatcctctccacaatggattccccttccacgtaggaagagcttcctgcctgtccctgccctgtctctggagaaaagggctagagctgccttttacaactgtaaccactgtaatgagaaggcacaggagacccagcactggagtcaaatggcattttacttcctctcgtttcaggttatgcatgacatcctgggatgtaagatcacagaatccccctccagcccaccagtcacacctaccccattcagtatttattaccctggccaggcctagtcctccactccctgcacaggactgagaaggcaatgaaaggtacaaacatgtaccatgaggtcttactaaccaaagtagggctgcccctcctgtcctgacagccccttggcctcccagcatggggaagcgtgaggagttgcccagcagtgagcagcccccctcactcctggccccatgagccgcagccacaggcagcagaggagggctaaggagaggaggaagcctcaagtccattgtttattaccccgactcttagcccagcacacagtaggcactggagaggaatgattcccagtttaaccacactacggtaccttttatgaagaaaaattagagcataaaatctactacaagctccataggaactcaaagatgagggcaaaactgtgagccaagaagcagagaaagaaaatagaaccagttattcttgatttaggggacctcaaccttgggttcagtctctgaggacaaagggaaaggtagttgttggcctgcctctcgcctgcacgtcactgctggactagctgtcgcatgtggctgggagctgcaaggccagtgcttgaggggccccagcagttccacaggtggtgaagcctgagttggcagaggaggagccagaagagaactgccctttctgcactggtggaaactagttatttatgccatgtggagagccagtgagatagatagatagtctgtttgttttgaggacttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacatttgtagaagaaaaaaaaaaaaaaaaaaaaaaaaaaaaa

SEQ ID NO: 58 - DNA, 1623 bp, Homo sapiens
aacagggcattcaccgcctggggcgcctgagtcatcaggacactgccaggagacacagaaccctagatgccctgcagaatccttcctgttacggtccccctccctgaaacatccttcattgcaatatttccaggaaaggaagggggctggctcggaggaagagaggtggggaggtgatcagggttcacagaggagggaactgaatgacatcccaggattacataaactgtcagaggcagccgaagagttcacaagtgtgaagcctggaagccggcgggtgccgctgtgtaggaaagaagctaaagcacttccagagcctgtccggagctcagaggttcggaagacttatcgaccatggagcgcgcgtcctgcttgttgctgctgctgctgccgctggtgcacgtctctgcgaccacgccagaaccttgtgagctggacgatgaagatttccgctgcgtctgcaacttctccgaacctcagcccgactggtccgaagccttccagtgtgtgtctgcagtagaggtggagatccatgccggcggtctcaacctagagccgtttctaaagcgcgtcgatgcggacgccgacccgcggcagtatgctgacacggtcaaggctctccgcgtgcggcggctcacagtgggagccgcacaggttcctgctcagctactggtaggcgccctgcgtgtgctagcgtactcccgcctcaaggaactgacgctcgaggacctaaagataaccggcaccatgcctccgctgcctctggaagccacaggacttgcactttccagcttgcgcctacgcaacgtgtcgtgggcgacagggcgttcttggctcgccgagctgcagcagtggctcaagccaggcctcaaggtactgagcattgcccaagcacactcgcctgccttttcctgcgaacaggttcgcgccttcccggcccttaccagcctagacctgtctgacaatcctggactgggcgaacgcggactgatggcggctctctgtccccacaagttcccggccatccagaatctagcgctgcgcaacacaggaatggagacgcccacaggcgtgtgcgccgcactggcggcggcaggtgtgcagccccacagcctagacctcagccacaactcgctgcgcgccaccgtaaaccctagcgctccgagatgcatgtggtccagcgccctgaactccctcaatctgtcgttcgctgggctggaacaggtgcctaaaggactgccagccaagctcagagtgctcgatctcagctgcaacagactgaacagggcgccgcagcctgacgagctgcccgaggtggataacctgacactggacgggaatcccttcctggtccctggaactgccctcccccacgagggctcaatgaactccggcgtggtcccagcctgtgcacgttcgaccctgtcggtgggggtgtcgggaaccctggtgctgctccaaggggcccggggctttgcctaagatccaagacagaataatgaatggactcaaactgccttggcttcaggggagtcccgtcaggacgttgaggacttttcgaccaattcaaccctttgccccacctttattaaaatcttaaacaacgaaaaaaaaaaaaaaaaa

SEQ ID NO: 59 - DNA, 9085 bp, Homo sapiens
agtagcgtctgggtccctggactaaagccgtcaaatgtaaccaattgctgaggagctctcccctaagaatcccgcctccactctgaggaacagcttcgctgatcaatggatcccctcctagacgcaatgagcgcgcggggcaagtggagaagcggctgaactgcccaatgaacaagcggtttccgtggttaggggcgtggcagaagcggtcgtcaggggcgtggcggcagttacttgggcggggccggtagcggcgggagctgcactggccaggggttccggctgtatatccatgagcgccgctggcagccggggagctgcaggaaccagactgggggcgagctgagcacctgtagtcaatcacacgcagaaataataatgatacttatgttagaagattgttttgagaagtgcatggagttactacatctgaagcatttagaacagtacctggcacagggttctgtcctcttcatttgcaagccactgctttatccacgagggtgctccctacttatgccagtgaattaatttttggcacagatgaatccttcatatttatctggatttagctggtagcatttgtctcctaagacttggtcacagaggaatccatgtgaccttcaggccttctgctctaaactggcaggagatcctgtttctactcacagcgtccgagggtctggtggccgagccctgaggggcgctgttgctcccaggtggcagaattcagcatcagagagccacacagctgaaagagatggatggcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgctcaagtcctgtcctcttctgaccaaagaatacattccaccgttgatctgggggaaaagtggacacatccagacagccttgtatgggaagatgggaagggtgaggtcgccacatccttatgggcaccggaagttcatcactatgtctgatggagccacttctacattcgacctcttcgagcccttggctgagcactgtgttggagatgatatcaccatggtcatctgccctggaattgccaatcacagcgagaagcaatacatccgcactttcgttgactacgcccagaaaaatggctatcggtgcgccgtgctgaaccacctgggtgccctgcccaacattgaattgacctcgccacgcatgttcacctatggctgcacgtgggaatttggagccatggtgaactacatcaagaagacatatcccctgacccagctggtcgtcgtgggcttcagcctgggtggtaacattgtgtgcaaatacttgggggagactcaggcaaaccaagagaaggtcctgtgctgcgtcagcgtgtgccaggggtacagtgcactgagggcccaggaaaccttcatgcaatgggatcagtgccggcggttctacaacttcctcatggctgacaacatgaagaagatcatcctctcgcacaggcaagctctttttggagaccatgttaagaaaccccagagcctggaagacacggacttgagccggctctacacagcaacatccctgatgcagattgatgacaatgtgatgaggaagtttcacggctataactccctgaaggaatactatgaggaagaaagttgcatgcggtacctgcacaggatttatgttcctctcatgctggttaatgcagctgacgatccgttggtgcatgaaagtcttctaaccattccaaaatctctttcagagaaacgagagaacgtcatgtttgtgctgcctctgcatgggggccacttgggcttctttgagggctctgtgctgttccccgagcccctgacatggatggataagctggtggtggagtacgccaacgccatttgccaatgggagcgtaacaagttgcagtgctctgacacggagcaggtggaggccgacctggagtgaggcctccggactctggcacgctccagcagccctcctctggaagctgcgtcccctcaccccctgtttcaggtctcccatctccctcagtgacctggatctgacctcacaccatcagcagggggcacccaccatgcacacctgtctcggagtaggcagctcttcctgggagctccaggctatttttgtgcttagttactggttttctccattgcattgttaggcatggtgacaagtgacagagttcttgccctctgtccagtttcagcatctggttgcttttaagccaagtacatctagtttccctattaaaaatgtgtctgaatagcgattttgctttgccaccaaaaggcttttccctgagaacagtgaaggatgtatgtcattttgtggtggttgtatgtgtccttacatagaccttaaaaagagctcacccttccaggccaatgctgaagacacagctccgcttgggagcctgagaacccaggcttcccaggccagagtgtggcttcttaaacggcaaaggaaattcctttgagtcacaagccaagttttcgccctgtctcctgagaccatttccctacgctttgctgctgctgagagttacgtgaggcacttgttaaaaattcagcctcccaggtccctcccctcggagaggctgattcactgggtctgggaaggagcctggggattttaatttttcacaagtgccccagatgattctcatcaccaagcaaattttggaaatgctgttcaacagcgcccttaaattggaaacatctttgcagctcgttttattgaaattcataatcaggggtgtcctctagctcccacggtctccagagcagcaaggccggctatggagctgccgtcgtgtgaccacagtgtgatgtctcagaagggctctgggtgggctgagcatctgggctgtgccctggctctgcttttcaccctggacaaagtcgctgtggacttcaatttcttcacctctaaaatgggggacttggaccaggtagattgctgagctcactaccaggttcaaagttcaatgacaaactcagtttactgaggtttgagagaacatccctccaggggagcctgggagctgctctcccagtctaagcatgtagatatcatcgtttgccttttgtgtgtgtgtgtcccttatttgataaaaagatgttttgagttgttttttttttaagcactcacttgtaattttagtttttaaacccaagtccctctaactttgcctttgataccaaacaattcaaaagttggatctgagtttggagaaagatatttccaacctaagtgggtattattttgaaaccagatttttaatttaatagcctatatttgtagtctgttggataggtgtttccaaagtgtgtcttctcaagtgaaaacgcaactctaggtttcaagtactccttttctccgatcctgtggtacttgaatatccaaaaaccctgcactttgaacaatcagctgttgctatctggaactaaacagaactatgagtaaaattgcctggatactttaaaaagatatttttcctccttcatctcctttgactccaggacagactggaatataagtagtgggtctgcatggatgtttcagggatcaaaggagccacctgggcgcctgagtgccaaccctcagggccacaggtgggtgtggtttgggcacgggtccaagtgactgtgacgggacccgtgggcatgggtccaggtctgtaacctgaagaagttgttttctgacaatcaccaaatcatccgaatgacatcaaaagcagcccttatctcagagactgagatttctgtggtctcaacttcgctttggtataatttctggcactcaccagcctctatcattatgactttccccccagtgtattatttctctaataggtttccttttcacgttcttttagcacagactggcactttaccctctcagtttggaagttagcccctctcctctgttacttttcccttcacccaactacagctgtgatctagaacattcatagtcatatttctgctactactaccttcatttatcaagactttttatgagaataggtaaaccaagcaataacttcctaggactgaatcaccaccccagaagagcgagaggctcctttcatatgcctgaggccacaccccttaacctgttctgacaaaatagtggctggcccatgtaccagctccattcagaaattcaggaagagaaaagacagccctgttgtcacacaaaccggtgtgggggagggtggagcctggtctgcacggcagtcctggtggcccctgtggaggacaggcagggctggcagcatagcctttgttgccacacaaccggaatttgctcccccaggactgtgggagccagtgtcccagctgaaatctttttagtgtgtggctctgaatggcactcacattccattttggctcacatgaaactaactgaagccctttgttcaagcttcaggctcttaggcatggaaatgagaatgtgactgtggctgtcttacaggaaaattcttgtttgtccctgaatgagagcacagaggcattgaattcacagagctgcaaacttgcctgataaatgagggagtggcagtttatagataggtcatcttttttccttcctccaggtgtccttgcctttcttcccaaagtcattcatttctgatgagtatatgaatccccctcttgctagtaaggttctatttgggctaaaacaaggctgaatttttaaagagtatttgaatatattttagaatcaaattgaggctataaattgcatcaatctggacaattccattgcaggaataatatgttaaaaaccaatggggagaagcacccacatctctcctgtagcactccgtgtctcataagcaatttgaagacacttacaagtaactgattccagtcaaattaggattaactgactcaaaaaatggtgtcaagtttctttaatgtttttatgttagaagtgagtttaacagacttgaagaaaactgttatcttttcctgctgtgagtttacacaaatgattccagagcagaatgaaagcagaaagctgttggttacaatattcttttaacctctctgcagcattttacacttactgggaaccttatgattcaccgtaagagtggaaatatacctgagttcgtgtcctaatggtctctaattcacattggatcgtgggcaaatcacctcacctctctgagcctgttccctcctcttagaccatctctaagaccacttcatctatttacacatcatttgcttgaacattgctgaacatctgcgtgaacttggcctctccagcccttgcaggtggaaacagctgtgtcaaggctcaaggctcacgctgaggggacttggagggagggggcttctgcattaagctttcctggtgaagacccttgatcttgtccaaagccctgtgtctttgactggcttctcttcagagtccccgttgtcatcgtaagacccttgctgtttggagggtggtcttgtgactgtggcagctgctggccgctggaatgaggagcctatctccatcctccagtgtgactcaggcagagcattgagaattcccagggcagaaatccttcctgctcaggctttcattctaaaactacagtcttcattaaagctgaactttctgggtagctgagcttatatgcccggcatctgaatgagagctctctttgtaactgtgtgacttgagatctagtttgccagctcctgggaaacaatacatgtgttcttgtttgtgtttgctcagcaagcagatgtctgagatgtaagaagcttttcttttcctgtggcattgattctgacttagagctgaagtaaaagatcactgaaacatcacgtcaagttgaagtcactcataggtctttgtcctttaggcaggacaggagagtcattaagaagcatttcactgtagcattctatcacaatatcatctggaattgttttctttgcccagaaagccttaacttgcctctagagaatccctggtattacaacgatattgcggcattagaattccaactcttctgctgtggaagtttgaagcgaagctgcagcaaaaccagagaatttcctcaagtggcctgtaggctccttgttatcttatgcccccacccctccctcaacaatatgagtgatccagaactggcccaaacacctcagctctggtccctttttgcccttcttggccttactctgttgttcaaagccactttggattgcttggatgcttcgaacagccatgaaaagtagcctgcctgtggcatttagaggccaagcaattgacagaaagggtttcttctacctctgttatctaagcagagggaagtaaacctctcaccgccccccacccctcactgcccccgattaccctagaattgctttcgccaaattgtagttgaagctaaggaaggggaatctggcccctgctgggagagggaactggaatgccacacaaggcaaggcctgcttccttccttcccctctgctgctgctgcctcggaacgctgcagcccaggcttcctcccacagtggcccttggaagcaggccgcagagtagacagctgctccttttggaagagtcagtcccctgtgttttctgaactgtttttcctagcatgtatgtgggtagagctttcatgcatctctagtaataataagctgaaattagttttttttttaattctccaatttaaaacttttaattaaaaagtaaattttaatgtcgaaaatgcaaacttggggagggcagaaagatcacacacaaggctgtcacttcatacttgcaggattgcacagcagccgggcagaggcgctcctcacttcccagatggggcggcgggcagcagagacgcacctcacttcctagacagtgcggcagccaggcacaggcacacctcacttcccagacagttgggcggccaggcaagcgctcctcacttcccagatggggcggctcccgggaagcggggctcctcacttcccagacagggtggccaggcagaggtgctcctcacttcccagaacaattctttatgaatttgataaaggactgaagtgcaactgaaagctgctagtgatgatctggtaatatacaatttgtccagtagccagtttgtttttattgtgttttctaaccataagagatcattaaaggcaaagcctgtatgacgctgtacacacacaaaaaaatggtcaccgcaggccatactaccaatgaaatggtaggtaaacaaatcttctggtcaagagaaaaaaaaaagaaatagcactctgcatgctttgctctacaagacgaatttccctagaaagaatccaatgaaggccgggcatagtggctcactcctgtaatcccagcactttggaggccgaggcgggtagatcacctgaggttaggagttcaagaccagcctggccaacatggtgaaaccccttctctactaaaaatgcaaaaattagctgggtgtggtggcgggcgcctgtaatcccagctactcgggaggctgaggtgggagaattgcttgaacccaggagacggaggttgcagtgagccgagatcacgcctctgcactccagcctgggcaacaagagtgagactccgtctccaaaaaaagaaaaggaatccagtgaaaatggctgcaattacaacaagaagtgaaggaagaagactggtgacatctctgaaggatgcagttgaggttgatccaggtttatccgaatatgctacctttctgagccttaaaccttcatctctcaggtgttgatttgcttctgatagcttcatcatttctccctgaagtcttttacactcttctgttagtttccttgtttcagtatcatgaagtgaagcactgtgtggttgtggcgtgggcccgtcttgcttagatgcattcagtgggacagctttgctgggttccatgtcattcaatttatcattttcattggggatctccatttggaatccattaattcatgaggttttgcctcattccacacagcttccatatctgaagtgtttagtggagcaaaaattgtaccataaacttgtgtttactcttttcattcggatcatagtcaaagggctgtagcattactgaaacagtcacagttgaccctgggtcaataattccactgttgggcctcacacagtaccggtgaggcacggtagtcttcactttgaaacacacttttctatccgatggatttcgcaatttaagatttgtagtgactacatctgtgaaggggcctttgaatttgaggtctatgggcgggtcgaggaccaggatctgctcgtgcttcgccgtggccccggaggcagacgccattggagagacagcgcagagcagggggcggcttgctcgctgggggcgggggacgatggcgagaggggagggggagcgagttcgcatctctccttttcctggttagactctgttcaaccacattcttatgttggcagatctgcttccagattgatttttagagcaccatcactttcacattcctgattctgattttgttttgttttgtttgggttttctgaaacttaaaatgctgccccgaaaatactatatttttgagtttgtgttctgaaagcctccgtgctgctggatctttggggggaaatacaggatccttcagcactgaggtgtttaagatttgcaactagcaatgcaattttttctaaatatggggatatttacctttattaagaaattatactaaacattgatgtccttgatcattttatgttctcatattacttttgattctactatgattgtgtggtggtgaacaaagatcattacaaacaaaaactgtaattttgttatatttgattcaatggaatttacctaaaaaataaagactaaaaatgtgg

SEQ ID NO: 60 - DNA, 1124 bp, Homo sapiens
tccgcaggcggaccgggggcaaaggaggtggcatgtcggtcaggcacagcagggtcctgtgtccgcgctgagccgcgctctccctgctccagcaaggaccatgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagttctggaactacctggagcgctgccgctactgcaacgtcctctgcggggagcgtgaggaggaggcacgggcttgccacgccacccacaaccgtgcctgccgctgccgcaccggcttcttcgcgcacgctggtttctgcttggagcacgcatcgtgtccacctggtgccggcgtgattgccccgggcacccccagccagaacacgcagtgccagccgtgccccccaggcaccttctcagccagcagctccagctcagagcagtgccagccccaccgcaactgcacggccctgggcctggccctcaatgtgccaggctcttcctcccatgacaccctgtgcaccagctgcactggcttccccctcagcaccagggtaccaggagctgaggagtgtgagcgtgccgtcatcgactttgtggctttccaggacatctccatcaagaggctgcagcggctgctgcaggccctcgaggccccggagggctggggtccgacaccaagggcgggccgcgcggccttgcagctgaagctgcgtcggcggctcacggagctcctgggggcgcaggacggggcgctgctggtgcggctgctgcaggcgctgcgcgtggccaggatgcccgggctggagcggagcgtccgtgagcgcttcctccctgtgcactgatcctggccccctcttatttattctacatccttggcaccccacttgcactgaaagaggcttttttttaaatagaagaaatgaggtttcttaaagcttatttttataaagctttttcataaaa

SEQ ID NO: 61 - DNA, 4175 bp, Homo sapiens; identical to SEQ ID NO: 45

SEQ ID NO: 62 - DNA, 3405 bp, Homo sapiens; identical to SEQ ID NO: 40

SEQ ID NO: 63 - DNA, 6930 bp, Homo sapiens
gaccgttgcttggcagacactggatggttatgagcctgaacaagctgaaaaggggcaggaaaagaagtggaggcagcattcttcctatttaaagctgcatcgcttgaaaaaagttttcgcagactgtgctggagctggtgctgaaaaagggggtttgcagaggctgccctggggctggtgctgaaagaagagcccacagctgacttcatggtgctacaataacctcagaatctacttttcactctcaggagaacccacatgtctaatatttagacatgatggcaaactgggcggaagcaagacctctcctcattcttattgttttattagggcaatttgtctcaataaaagcccaggaagaagacgaggatgaaggatatggtgaagaaatagcctgcactcagaatggccagatgtacttaaacagggacatttggaaacctgccccttgtcagatctgtgtctgtgacaatggagccattctctgtgacaagatagaatgccaggatgtgctggactgtgccgaccctgtaacgccccctggggaatgctgtcctgtctgttcacaaacacctggaggtggcaatacaaattttggtagaggaagaaagggacaaaagggagaaccaggattagtgcctgttgtaacaggcatacgtggtcgtccaggaccggcaggacctccaggatcacagggaccaagaggagagcgagggccaaaaggaagacctggccctcgtggacctcagggaattgatggagaaccaggtgttcctggtcaacctggtgctccaggacctcctggacatccgtcccacccaggacccgatggcttgagcaggccgttttcagctcaaatggctgggttggatgaaaaatctggacttgggagtcaagtaggactaatgcctggctctgtgggtcctgttggcccaaggggaccacagggtttacaaggacagcaaggtggtgcaggacctacaggacctcctggtgaacctggtgatcctggaccaatgggtccgattggttcacgtggaccagagggccctcctggtaaacctggggaagatggtgaacctggcagaaatggaaatcctggtgaagtgggatttgcaggatctccgggagctcgtggatttcctggggctcctggtcttccaggtctgaagggtcaccgaggacacaaaggtcttgaaggccctaaaggtgaagttggagcacctggttccaagggtgaagctggccccactggtccaatgggtgccatgggtcctctgggtccgaggggaatgccaggagagagagggagacttgggccacagggtgctcctggacaacgaggtgcacatggtatgcctggaaaacctggaccaatgggtcctcttgggataccaggctcttctggttttccaggaaatcctggaatgaagggagaagcaggtcctacaggggcgcgaggccctgaaggtcctcaggggcagagaggtgaaactgggcccccaggtccagttggctctccaggtcttcctggtgcaataggaactgatggtactcctggtgccaaaggcccaacgggctctccgggtacctctggtcctcctggctcagcagggcctcctggatctccaggacctcagggtagcactggtcctcagggaattcgaggccaaccgggtgatccaggagttccaggtttcaaaggagaagctggcccaaaaggggaaccagggccacatggtattcagggtccgataggcccacccggtgaagaaggcaaaagaggtcccagaggtgacccaggaacagttggtcctccagggccagtgggagaaaggggtgctcctggcaatcgtggttttccaggctctgatggtttacctgggccaaagggtgctcaaggagaacggggtcctgtaggttcttcaggacccaaaggaagccagggggatccaggacgtccaggggaacctgggcttccaggtgctcggggtttgacaggaaatcctggtgttcaaggtcctgaaggaaaacttggacctttgggtgcgccaggggaagatggccgtccaggtcctccaggctccataggaatcagagggcagcccgggagcatgggccttccaggccccaaaggtagcagtggtgaccctgggaaacctggagaagcaggaaatgctggagttcctgggcagaggggagctcctggaaaagatggtgaagttggtccttctggtcctgtgggcccgccgggtctagctggtgaaagaggagaacaaggacctccaggccccacaggttttcaggggcttcctggtcctccagggcctcctggagaaggtggaaaaccaggtgatcaaggtgttcctggagatcccggagcagttggcccgttaggacctagaggagaacgaggaaatcctggggaaagaggagaacctgggataactggactccctggtgagaagggaatggctggaggacatggtcctgatggcccaaaaggcagtccaggtccatctgggacccctggagatacaggcccaccaggtcttcaaggtatgccgggagaaagaggaattgcaggaactcctggccccaagggtgacagaggtggcataggagaaaaaggtgctgaaggcacagctggaaatgatggtgcaagaggtcttccaggtcctttgggccctccaggtccggcaggtcctactggagaaaagggtgaacctggtcctcgaggtttagttggccctcctggctcccggggcaatcctggttctcgaggtgaaaatgggccaactggagctgttggttttgccggaccccagggtcctgacggacagcctggagtaaaaggtgaacctggagagccaggacagaagggagatgctggttctcctggaccacaaggtttagcaggatcccctggccctcatggtcctaatggtgttcctggactaaaaggtggtcgaggaacccaaggtccgcctggtgctacaggatttcctggttctgcgggcagagttggacctccaggccctgctggagctccaggacctgcgggacccctaggggaacccgggaaggagggacctccaggtcttcgtggggaccctggctctcatgggcgtgtgggagatcgaggaccagctggcccccctggtggcccaggagacaaaggggacccaggagaagatgggcaacctggtccagatggcccccctggtccagctggaacgaccgggcagagaggaattgttggcatgcctgggcaacgtggagagagaggcatgcccggcctaccaggcccagcgggaacaccaggaaaagtaggaccaactggtgcaacaggagataaaggtccacctggacctgtggggcccccaggctccaatggtcctgtaggggaacctggaccagaaggtccagctggcaatgatggtaccccaggacgggatggtgctgttggagaacgtggtgatcgtggagaccctgggcctgcaggtctgccaggctctcagggtgcccctggaactcctggccctgtgggtgctccaggagatgcaggacaaagaggagatccgggttctcggggtcctataggaccacctggtcgagctgggaaacgtggattacctggaccccaaggacctcgtggtgacaaaggtgatcatggagaccgaggcgacagaggtcagaagggccacagaggctttactggtcttcagggtcttcctggccctcctggtccaaatggtgaacaaggaagtgctggaatccctggaccatttggcccaagaggtcctccaggcccagttggtccttcaggtaaagaaggaaaccctgggccacttgggccaattggacctccaggtgtacgaggcagtgtaggagaagcaggacctgagggccctcctggtgagcctggcccacctggccctccgggtccccctggccaccttacagctgctcttggggatatcatggggcactatgatgaaagcatgccagatccacttcctgagtttactgaagatcaggcggctcctgatgacaaaaacaaaacggacccaggggttcatgctaccctgaagtcactcagtagtcagattgaaaccatgcgcagccccgatggctcgaaaaagcacccagcccgcacgtgtgatgacctaaagctttgccattccgcaaagcagagtggtgaatactggattgatcctaaccaaggatctgttgaagatgcaatcaaagtttactgcaacatggaaacaggagaaacatgtatttcagcaaacccatccagtgtaccacgtaaaacctggtgggccagtaaatctcctgacaataaacctgtttggtatggtcttgatatgaacagagggtctcagttcgcttatggagaccaccaatcacctaatacagccattactcagatgacttttttgcgccttttatcaaaagaagcctcccagaacatcacttacatctgtaaaaacagtgtaggatacatggacgatcaagctaagaacctcaaaaaagctgtggttctcaaaggggcaaatgacttagatatcaaagcagagggaaatattagattccggtatatcgttcttcaagacacttgctctaagcggaatggaaatgtgggcaagactgtctttgaatatagaacacagaatgtggcacgcttgcccatcatagatcttgctcctgtggatgttggcggcacagaccaggaattcggcgttgaaattgggccagtttgttttgtgtaaagtaagccaagacacatcgacaatgagcaccaccatcaatgaccaccgccattcacaagaactttgactgtttgaagttgatcctgagactcttgaagtaatggctgatcctgcatcagcattgtatatatggtcttaagtgcctggcctccttatccttcagaatatttattttacttacaatcctcaagttttaattgattttaaatatttttcaatacaacagtttaggtttaagatgaccaatgacaatgaccacctttgcagaaagtaaactgattgaataaataaatctccgttttcttcaatttatttcagtgtaatgaaaaagttgcttagtatttatgaggaaattcttcttcctggcaggtagcttaaagagtggggtatatagagccacaacacatgtttattttgcttggctgcagttgaaaaatagaaattagtgcccttttgtgacctctcattccaagattgtcaattaaaaatgagtttaaaatgtttaacttgtgatcgagacctacatgcatgtcttgatattgtgtaactataatagagactctttaaggagaatcttaaaaaaaaaaaaacgtttctcactgtcttaaatagaatttttaaatagtatatattcagtggcattttggagaacaaagtgaatttacttcgacttcttaaatttttgtaaaagactataagtttagacatctttctcattcaaatttaaagatatctttctcctcttgatcaatctatcaatattgatagaagtcacactagtatataccatttaatacatttacactttcttatttaagaagatattgaatgcaaaataattgacatatagaactttacaaacatatgtccaaggactctaaattgagactcttccacatgtacaatctcatcatcctgaagcctataatgaagaaaaagatctagaaactgagttgtggagctgactctaatcaaatgtgatgattggaattagaccatttggcctttgaactttcataggaaaaatgacccaacatttcttagcatgagctacctcatctctagaagctgggatggacttactattcttgtttatattttagatactgaaaggtgctatgcttctgttattattccaagactggagataggcagggctaaaaaggtattattatttttcctttaatgatggtgctaaaattcttcctataaaattccttaaaaataaagatggtttaatcactaccattgtgaaaacataactgttagacttcccgtttctgaaagaaagagcatcgttccaatgcttgttcactgttcctctgtcatactgtatctggaatgctttgtaatacttgcatgcttcttagaccagaacatgtaggtccccttgtgtctcaatactttttttttcttaattgcatttgttggctctattttaatttttttcttttaaaataaacagctgggaccatcccaaaagacaagccatgcatacaactttggtcatgtatctctgcaaagcatcaaattaaatgcacgcttttgtcatgtcagtggtttttgttttgtgaaattcctttgaccatattagatctatttcatttccaatagtgaaaaggagatgtggtggtatactttgtttgccatttgtttaaaagatacaacggataccttctatcatgtatgtactggcttataaatgaaaatctatctacaacattacccacaaaggcaacatgacaccaattatcactgcctctgcccttaaaaatgtcagagtagtattattgataaaaagggcaagcaatagatttttcatgactgaataaactgtaataataaaacatatgtctcaaagtgtatcacatatgaatttagcctaattgttttcagtttcattctcaatatttagtttacaacatcattttcccctaaactggttatattttgacctgtatatcttaaatttgagtatttatatgcctaaatacatgtgtgagttttgtttgacttccaagtccaaactataagattatataagttcatatagatgaatcagaaatatgtggtaatactattaagtcacaaacactaacaatttccaactatagaaataacagttcttatttggattttgggaatgctaccaata

SEQ ID NO: 64 - DNA, 2545 bp, Homo sapiens
atccaatacaggagtgacttggaactccattctatcactatgaagaaaagtggtgttcttttcctcttgggcatcatcttgctggttctgattggagtgcaaggaaccccagtagtgagaaagggtcgctgttcctgcatcagcaccaaccaagggactatccacctacaatccttgaaagaccttaaacaatttgccccaagcccttcctgcgagaaaattgaaatcattgctacactgaagaatggagttcaaacatgtctaaacccagattcagcagatgtgaaggaactgattaaaaagtgggagaaacaggtcagccaaaagaaaaagcaaaagaatgggaaaaaacatcaaaaaaagaaagttctgaaagttcgaaaatctcaacgttctcgtcaaaagaagactacataagagaccacttcaccaataagtattctgtgttaaaaatgttctattttaattataccgctatcattccaaaggaggatggcatataatacaaaggcttattaatttgactagaaaatttaaaacattactctgaaattgtaactaaagttagaaagttgattttaagaatccaaacgttaagaattgttaaaggctatgattgtctttgttcttctaccacccaccagttgaatttcatcatgcttaaggccatgattttagcaatacccatgtctacacagatgttcacccaaccacatcccactcacaacagctgcctggaagagcagccctaggcttccacgtactgcagcctccagagagtatctgaggcacatgtcagcaagtcctaagcctgttagcatgctggtgagccaagcagtttgaaattgagctggacctcaccaagctgctgtggccatcaacctctgtatttgaatcagcctacaggcctcacacacaatgtgtctgagagattcatgctgattgttattgggtatcaccactggagatcaccagtgtgtggctttcagagcctcctttctggctttggaagccatgtgattccatcttgcccgctcaggctgaccactttatttctttttgttcccctttgcttcattcaagtcagctcttctccatcctaccacaatgcagtgcctttcttctctccagtgcacctgtcatatgctctgatttatctgagtcaactcctttctcatcttgtccccaacaccccacagaagtgctttcttctcccaattcatcctcactcagtccagcttagttcaagtcctgcctcttaaataaacctttttggacacacaaattatcttaaaactcctgtttcacttggttcagtaccacatgggtgaacactcaatggttaactaattcttgggtgtttatcctatctctccaaccagattgtcagctccttgagggcaagagccacagtatatttccctgtttcttccacagtgcctaataatactgtggaactaggttttaataattttttaattgatgttgttatgggcaggatggcaaccagaccattgtctcagagcaggtgctggctctttcctggctactccatgttggctagcctctggtaacctcttacttattatcttcaggacactcactacagggaccagggatgatgcaacatccttgtctttttatgacaggatgtttgctcagcttctccaacaataagaagcacgtggtaaaacacttgcggatattctggactgtttttaaaaaatatacagtttaccgaaaatcatataatcttacaatgaaaaggactttatagatcagccagtgaccaaccttttcccaaccatacaaaaattccttttcccgaaggaaaagggctttctcaataagcctcagctttctaagatctaacaagatagccaccgagatccttatcgaaactcattttaggcaaatatgagttttattgtccgtttacttgtttcagagtttgtattgtgattatcaattaccacaccatctcccatgaagaaagggaacggtgaagtactaagcgctagaggaagcagccaagtcggttagtggaagcatgattggtgcccagttagcctctgcaggatgtggaaacctccttccaggggaggttcagtgaattgtgtaggagaggttgtctgtggccagaatttaaacctatactcactttcccaaattgaatcactgctcacactgctgatgatttagagtgctgtccggtggagatcccacccgaacgtcttatctaatcatgaaactccctagttccttcatgtaacttccctgaaaaatctaagtgtttcataaatttgagagtctgtgacccacttaccttgcatctcacaggtagacagtatataactaacaaccaaagactacatattgtcactgacacacacgttataatcatttatcatatatatacatacatgcatacactctcaaagcaaataatttttcacttcaaaacagtattgacttgtataccttgtaatttgaaatattttctttgttaaaatagaatggtatcaataaatagaccattaatcag

SEQ ID NO: 65 - DNA, 1681 bp, Homo sapiens
ttttgtctgtcctggattggagccgtccctataaccatctagttccgagtacaaactggagacagaaataaatattaaagaaatcatagaccgaccaggtaaaggcaaagggatgaattcctacttcactaacccttccttatcctgccacctcgccgggggccaggacgtcctccccaacgtcgccctcaattccaccgcctatgatccagtgaggcatttctcgacctatggagcggccgttgcccagaaccggatctactcgactcccttttattcgccacaggagaatgtcgtgttcagttccagccgggggccgtatgactatggatctaattccttttaccaggagaaagacatgctctcaaactgcagacaaaacaccttaggacataacacacagacctcaatcgctcaggattttagttctgagcagggcaggactgcgccccaggaccagaaagccagtatccagatttacccctggatgcagcgaatgaattcgcacagtggggtcggctacggagcggaccggaggcgcggccgccagatctactcgcggtaccagaccctggaactggagaaggaatttcacttcaatcgctacctaacgcggcgccggcgcatcgagatcgccaacgcgctttgcctgaccgagcgacagatcaaaatctggttccagaaccgccggatgaagtggaaaaaagaatctaatctcacatccactctctcggggggcggcggaggggccaccgccgacagcctgggcggaaaagaggaaaagcgggaagagacagaagaggagaagcagaaagagtgaccaggactgtccctgccacccctctctccctttctccctcgctccccaccaactctcccctaatcacacactctgtatttatcactggcacaattgatgtgttttgattccctaaaacaaaattagggagtcaaacgtggacctgaaagtcagctctggaccccctccctcaccgcacaactctctttcaccacgcgcctcctcctcctcgctcccttgctagctcgttctcggcttgtctacaggcccttttccccgtccaggccttgggggctcggaccctgaactcagactctacagattgccctccaagtgaggacttggctcccccactccttcgacgcccccacccccgccccccgtgcagagagccggctcctgggcctgctggggcctctgctccagggcctcagggcccggcctggcagccggggagggccggaggcccaaggagggcgcgccttggccccacaccaacccccagggcctccccgcagtccctgcctagcccctctgccccagcaaatgcccagcccaggcaaattgtatttaaagaatcctgggggtcattatggcattttacaaactgtgaccgtttctgtgtgaagatttttagctgtatttgtggtctctgtatttatatttatgtttagcaccgtcagtgttcctatccaatttcaaaaaaggaaaaaaaagagggaaaattacaaaaagagagaaaaaaagtgaatgacgtttgtttagccagtaggagaaaataaataaataaataaatcccttcgtgttaccctcctgtataaatccaacctctgggtccgttctcgaatatttaataaaactgatattatttttaaaacttta

SEQ ID NO: 66 - DNA, 6103 bp, Homo sapiens
cgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtgtatccaccgccactgtgtgaaactgtatctgccactcatttccccagttggtgtttccaacaaagtaactttccctgttttcccctgtagtccccccctttttttttacacatatttgcatatgtatgatagtgtgcatgtggttgtcatttttatttcaccaccataaaacccttgagcacaacagcaaataagcagacggaccaaaagttatttatgattctgggggaaaaataacccaaaggcatgctccagacataaatagctcactgcaggaacgagttcacagattagaagggagcacttgtgatcaacgtcagttaggcagagcaagtttatttaatgtaaaagaaaagttgattctgatttatcaggattatcagggtgctttgggttttgattttgttgttgttgttgttttcctttctttctttttttatacacacaataagttagcacatgtttatttgaaacaagcaaccaaacagcaatgaaaacatattgattgtttccagtctctgggccgaagtattgcgaagcatttgaaaagctttcacgatttgtgtagatgattatgaaggacctgcttgttgcaagagaacatcagtgatttttttagttactcaccaaggccttttgtcccagagccagttccctctgggagttcttatgaacatttctcaccttaatatggaggagagaatagtattccaatcatggatgtatcaaattctagtcatttagtttaagtgaaaagaggtttgattgcatattaaattgttattctgtctccttatgttgccatatgaatagctattttttttctttcacttttgacatttgggatgaaaagccatatgtatcataaatatcagatgtaagtcattaaaaactgccttcctgggacttttacatcttttaaaaggtgaattacttaccttatgtacagaataaataatgctcaggaaagagcaagtatttttccatgcattctcaggggatctttttactcccctttgtttgattagttagggccccaatgccaggtaggaggaagggctggggcaatggtagagtgagaggaagacaaacccagctgcagatcatgcttttctaggagccgacatgctaaataaattagaatgtaggaggatcagccacagttgactcaacaaagacaaaagccagccaccaccttcaactgttggcacagctgtgcggtgctggctgtcccaatgcagaaagctggtgggaaggaattcctcatcatcactttctttaatgtagccaatttaggcagggtaatgacggcaatagagagctgctccttgtcattatgagacgtgggataagaagagtgcaacagtgagccaaacacattttggtatagttatttttttcttcttttgttttctttcttttttaacacttagtaagcatgagaggagaggtagaaaaatacccttttttcaacatatagttgtcagatgctttgtgcatgcaaatcatgctttaggcagtgcggtatttcttaaaaactggccaattcaccataaccaatttcccttatggatggactaggctggtatatacatatttgaaaagttttacttcaaagaattccatcgaatagaataggggtaaaagggaggaggaaaacatgtcacagctgtaccatctctaaaaaggtgtttttatggtgaatgttttggatttagattttggatcccccgtcccctcaagcatgatagttttggatatttgcttgctgtgtgaattgacaagcacttttactgacaaatggtgaggctcagtcagaacctccaccctcccccacaccaaagacaggggcagcgtagtattcaaaccagtattgtggtggggaataattgtatacatgtaaattatcaagccctatgagtggaagaattttttcaaattatttttgtccctctatatattgatttatattatgtataactatctctttatataaactatatataattatatatatataactatataattatatatatataactatatatataactatatatatgtatcccctagtattggatcatgaagagctcttcatgcattctttgcaaaggaggttataaagttacgccctcagaacatttataactataagaatgtgccagttaaagtgctcaacaggaaatatgacagtttaaaagcattgtaaaactcacatagcttacttctctctctaaagtgcaacaaggatgaatagaatgggccaaggtatgacaattaatggttctgcatgacctagccactgctgggggttttcttctataacgttgtccttgtgaaaacttttgtgaaattaaaaaaaaaggagttacaaatttta

SEQ ID NO: 67 - DNA, 1973 bp, Homo sapiens
gggatattggagtagcaagaggctgggaagccatcacttaccttgcactgagaaagaagacaaaggccagtatgcacagctttcctccactgctgctgctgctgttctggggtgtggtgtctcacagcttcccagcgactctagaaacacaagagcaagatgtggacttagtccagaaatacctggaaaaatactacaacctgaagaatgatgggaggcaagttgaaaagcggagaaatagtggcccagtggttgaaaaattgaagcaaatgcaggaattctttgggctgaaagtgactgggaaaccagatgctgaaaccctgaaggtgatgaagcagcccagatgtggagtgcctgatgtggctcagtttgtcctcactgaggggaaccctcgctgggagcaaacacatctgacctacaggattgaaaattacacgccagatttgccaagagcagatgtggaccatgccattgagaaagccttccaactctggagtaatgtcacacctctgacattcaccaaggtctctgagggtcaagcagacatcatgatatcttttgtcaggggagatcatcgggacaactctccttttgatggacctggaggaaatcttgctcatgcttttcaaccaggcccaggtattggaggggatgctcattttgatgaagatgaaaggtggaccaacaatttcagagagtacaacttacatcgtgttgcggctcatgaactcggccattctcttggactctcccattctactgatatcggggctttgatgtaccctagctacaccttcagtggtgatgttcagctagctcaggatgacattgatggcatccaagccatatatggacgttcccaaaatcctgtccagcccatcggcccacaaaccccaaaagcgtgtgacagtaagctaacctttgatgctataactacgattcggggagaagtgatgttctttaaagacagattctacatgcgcacaaatcccttctacccggaagttgagctcaatttcatttctgttttctggccacaactgccaaatgggcttgaagctgcttacgaatttgccgacagagatgaagtccggtttttcaaagggaataagtactgggctgttcagggacagaatgtgctacacggataccccaaggacatctacagctcctttggcttccctagaactgtgaagcatatcgatgctgctctttctgaggaaaacactggaaaaacctacttctttgttgctaacaaatactggaggtatgatgaatataaacgatctatggatccaggttatcccaaaatgatagcacatgactttcctggaattggccacaaagttgatgcagttttcatgaaagatggatttttctatttctttcatggaacaagacaatacaaatttgatcctaaaacgaagagaattttgactctccagaaagctaatagctggttcaactgcaggaaaaattgaacattactaatttgaatggaaaacacatggtgtgagtccaaagaaggtgttttcctgaagaactgtctattttctcagtcatttttaacctctagagtcactgatacacagaatataatcttatttatacctcagtttgcatatttttttactatttagaatgtagccctttttgtactgatataatttagttccacaaatggtgggtacaaaaagtcaagtttgtggcttatggattcatataggccagagttgcaaagatcttttccagagtatgcaactctgacgttgatcccagagagcagcttcagtgacaaacatatcctttcaagacagaaagagacaggagacatgagtctttgccggaggaaaagcagctcaagaacacatgtgcagtcactggtgtcaccctggataggcaagggataactcttctaacacaaaataagtgttttatgtttggaataaagtcaaccttgtttctactgtttt

SEQ ID NO: 68 - DNA, 5546 bp, Homo sapiens
aggaaaagacaatttctctctgattcagaatcctgaaaatgtgatctcccttaaaaagaggacagtgctgctgtgagtttgacgaagtggacatcacctgcagtcagtccagagctgcccagtcttgaatataatcatggccaaaccttatgaatttaactggcagaaggaagttccctcctttttgcaagaaggaacagtttttgacagatacgaggaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcagcttttgaaatcctgtcatgcagtgtcccaaacgcaaggcgaaggagatgcagcagatggtgaaattggaagccgagatggaccgcagaccagcaacagtagtatgaaactccaaaatgcaaactgaagcagcaaacccacaaagcatcaaaagactcactcacaaacttctgaacacaaactccatggatgaaagctgtttattttgtttcctttatgtgtaaacaagatgatatctgaaaccagagagacttggaatgtctgactgacttctatttaacagcttgagtattgcatttccttggccaaacaaaaatagctacaaatccacaaaaatttactattccagtaaggcagagtccaaccattgataatacaacttaaacatgtttgctataaaataccatcacaagtaaatgagcttggtgtgaacaactctcctttgtgatgccttaggacatgtttgaactgcagcaaaaaacaaaaacaaaaaacagtgcattagcaatttcatagcaagtgcatgcactaggaaaagaaaactctgtctacaagtttattagcagaagtggtggtctgctagacaaataattttgcaaaatttttctacatctaagttacctcatcagtaagtgccatgtctctaccatgccatcagaggctaatttcctgtaaaagttgtggaaattgttagaacaatagaaaaatagagcagtgtatgtgtgccaaaactcatcattactcaaaggagaactgtgttaggcacatttaagaaagtttacatctgacattgctttataggaattgtttctgcagattccggatattataattcacaccataaagattgtgaagtggttattggcaaacgtttgtaaatgtgaccatgtataaagtatttatactctttaattcacactgttagagagcaaaatcatctaagtattgccacatgacaagattagtaaacaggaatactagaactatgtttgcatgatacacaagcaccaataaagactaatccatacacagttaacctaatgccaaataaatactggttaaataaatgtatggcacagaatataatttgactatcaagacttttagcataatgaaaaaccctctctctatatatatatgtgtatatgaattatgtgggcattcttgatacttcaagttctagtttgaaaaaaatacataactaatttaattttacacaaaaatatttatgcagattttcagaatttcatatcaggaaatgacctttttatgtctgttaaatatcaaaacaatttgctacagtgttaatctgcatggtctttaagcctgctgtagttgagttgcagacagtgcatgaaaaagtattccgctgggaattgagccatgccaccaaagccaagaggagcgcatggaaacccggtagtctagaactaatcagattactgattttagggcacagcaccagatgaattgttgtatatgcttgtaaaaattgattctgtgtgttcctctgaacaaagcggagaaaatgatgataccatcaatattgaaattaaacttccaacttctctaataaaaaattaaaacacgcataacactcgtcaagagtatttgctcccaagacacattctagcaaatgttttgcctttttcatatacatgatatcatcgttattttcaaagggggcttattaataccctcagcatgtttttcacccaaatgatgcaaaacatgcagattctagttgacttcagttgtaatagacttgtttttctcctatttatgatttgaagtggattctgtaaaatatctcttgttcttagtttccttatctgtaaaacagtggagttagactacatatcttttggcactaacatctcatgaaaaattatggttaataaaatatcaccacatttggattgccaattttcaaaaaaaaaaaaaaaaaaaaa

SEQ ID NO: 69 - DNA, 10078 bp, Homo sapiens
gcagtttattctgggcctgtgtggaatagaaagacaattctttatttgactggtaggaaagaaaagagaagactcctcagggtttccaaggaggactggagcggctgctttagtgaagaagtgaagaatcaaggaagtaaaggacctgtctcaaagtcacacaactaggaaatcttgaggagtctgatacttttcatcctccagctataaaatcatcttgtagggggaagctgtacattggtggaaaataaaaggcaagcagttcctggcccgtgatattccagttagaggtgtctgactgacagcatgttggcaccgagggaagcgatgggcttcggctccaggtttctgtcctgagaccacagcagaatgtgccttggacaaaggcttggactccttgatcttctggtaacttcaaaaatctggtctcagggtggtgaactttttcttcgaattcctaacctgtgagcttacgatgatggtgcctgtccattaactgaacaactgtggttttgaacttcttgaggccagggactgtgtctgaaaacaccgacggtggctaactcaagggagacgtctggtgaacacccgtgggatctaaagaacaagctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcagaatctattggtggtacaccaataagaggagcccttcagattgagcagagtgaagagtctgaccaaggaaaatatgagtgtgttgccaccaacagcgcgggcactcgctattccgctcctgccaatttatatgtcagagagctgcgagaagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaaagccgtcagctcctcctcaagacattagttgcaccagcccaagttccactagtattttggtaagttggcaacctccaccagtggaaaaacagaatggcattatcactgaatactccatcaagtacactgcagtggatggggaagatgacaagcctcacgagattttgggaattccttcggacactaccaaataccttttggaacagctggaaaaatggactgaataccggatcactgtgacagcccatacagatgtcggccctggccctgagagcttgtccgtgttgattcgaaccaatgaagatgttcctagtggtcctcctcgcaaagtcgaggtagaggctgtcaactcaacatctgttaaagtctcatggcgctcacccgtgcccaataaacagcatggccagataagaggatatcaggtgcattatgtgaggatggaaaatggtgagcccaagggccagcccatgctgaaagatgtcatgctggctgatgcacagtgggaatttgatgatactactgaacatgacatgatcatttctgggctccagcctgaaacttcctactccctcaccgtcacagcctacacaaccaaaggagatggtgctcgcagcaagcccaaactggtgtccaccactggggcagttccagggaaacctcggcttgtgattaaccacactcagatgaatactgctcttattcagtggcaccctccggtggacacatttggacctcttcagggctaccgtctaaaatttggccgcaaggatatggagccacttactactcttgagttctctgaaaaagaagatcactttacagctacagacatccacaagggagcatcatacgtcttcaggctctcagccagaaacaaagtgggctttggggaggagatggtgaaggagatttccattccagaagaagtaccaactggattccctcaaaaccttcactcagaaggcaccacttcaacctccgtccagttatcttggcaaccacctgtcctggcagagagaaatggcattatcaccaagtatacccttctttatagggatatcaacatcccccttctcccgatggagcagcttattgttccagctgacaccactatgacactcactggcttaaaaccagataccacatacgatgtaaaagtacgtgctcatacgagcaaagggcccgggccatatagtcccagtgtccagttcaggacactgcctgtggatcaagtgtttgcaaaaaattttcatgtcaaagcagtaatgaagacttccgtgttgctgtcttgggagattccagagaattataactccgccatgcctttcaaaattctttatgatgatgggaaaatggtagaagaagtggatggccgagccacacagaagttaattgtcaacctgaagcctgagaaatcatattcatttgtgctgacaaatcgtggaaacagtgctggtgggctgcagcacagggtcacggcaaagactgcaccagatgtattacgtaccaagcctgccttcattgggaagaccaacttggatggcatgattactgtgcaactgcctgaagtacctgcaaatgagaatataaaaggttactacataataattgtgcctttgaagaaatctcgcgggaaatttatcaagccatgggagagtccagatgaaatggaattagatgagctgcttaaggagatatctaggaagcgcagaagcatccgttatgggagagaagttgaattaaagccatatattgccgctcactttgatgtccttcccactgagttcaccctgggggatgacaagcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaaggaagagggcagagtccgactctagaaaaagcagcataccgaacaataaggagatcccttcacaccacccaacagaccctgtagaactgaggcgccttaactttcaaacaccgggtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtgaagtgtgaccagtattggcctagcagaggcacagaaacccacggactcgttcaagtaacgctgcttgatactgtggagctggccacatattgtgttcgaacatttgcactttacaagaatggttcaagtgagaagagagaagtgagacaattccagttcaccgcctggcctgatcatggtgttccagaacaccctacaccttttctagctttcttacgtagagtcaaaacctgtaaccctcccgatgctggtccgatggttgtgcactgcagtgcgggagttggccggactggttgcttcatcgtcatagatgccatgttagaaagaataaagcatgaaaaaactgtagatatttatggccatgtaactttaatgagagcccagaggaactatatggttcaaacagaagaccaatacatctttatccatgatgcactgttagaagcagtgacttgtggaaataccgaagtgccagctagaaacttgtatgcctacattcagaagctgacacaaatagaaacgggagagaatgtcacaggaatggagctcgaatttaagcgtctagccagctcaaaagctcacacctcaaggtttatcagtgccaatcttccatgtaataaattcaaaaatcgccttgttaatattatgccatatgaatccacaagggtatgcctgcagcctatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcagcgcgggcgttggaagaactggagtcttcataacgctaagcattgttttggaaagaatgagatatgaaggagttgtagatatcttccagactgtcaaaatgttaagaacacaacgaccagctatggtacagacagaggatcaatatcagttttcctatcgtgccgcactagagtacctgggcagctttgaccactatgcaacgtagaaacccctgacccattctggatttttactacaggcccttcaatatccatggagtctcttctgagccatacagggcacttgagaagtccttcttaacttctagctaacaactacttagtgggactattacacacaaaacaaattaaaaacaaattattccaggtggaccaagaattcacagtttaataatctaacctgaaaaataatgaagagaatcctgactgatgaggcatctgaaggattttatttacagatacctcaaggattcaaaatcaagggaagaagaaatcacagcaaagaaccaccatcttattcaggattgcttgaaaggtgcaaggagaaattgccagaatgctgcagttcagcacaagatatgtgctggtgtggcttctcacaatgaaacggactctgctttgacatcgccccttcccaccatactgctcataataacattttagggggaaaggggagggaatgtttaaaaagaaagtccttgatttagttttttagtattgtaaagatactgctgacctgtgcttcatttctaactgtgtaaacttttttttaacaaaatgtatcattcgataaagtgaattttaaaaaagttacataactcttcatttttttatttccaaatcgtaggtttttttaagctgtagaactgttatctgtaatatcttgctgtagaaatatcaaatcatttgaaaatttgcacatttttgtgcaaaactcaatctacagtatcagtctcgtcagatatattaattttacacttcagttttgattggtgagaaagtacccattctcttcaaataatcaaagataattattattttgttttgtttttggaatcaacagggaggcgcaaagtataaagttgctgctaacatatatacatatatatccatattttataagggtgtctatgtatatatagacagtgtgtccacacaaaaaatagatacagttatcagtcagtcagttcttccatgatttagtttttttaaacgtagaaaagctattgtaaacatctctttccatttattcttaattttttgacatattggtatttctttaaagggaaatgaggaatgcacatcagtgattgattgtcaaacctcaccccctgatttcctacctaatctacccccacctaaccaatcaatcacatccacaaattgttttgtttgtttgttagtcaggcttccaacaaagttcaatatttctaacactctagtgcaataaaaattattattaaatagctaagaggtgtgcatgtgggaaaggtcagtgcatatccctttaggaggggagaatgttgtaatatatcagctatcgagttgtttaaaaaaagtgtattcaatcgtatattgtctatagtatgtgctatgaaatttgcatttatgatatgtaacaggggcaaagccaaattcatgttactctgttcagtcagaaacattttgtggcatacagcattcctgggaagtgctgtactttgtttcgttttggttttagttttgcatttagagtgccttataattgatgcctattttaatagcatttctttttagcttttggttcgtatttccattcactgttcgtatctgttactttctattaaagcattatctgtttaccacatgtacaaaaactctttgaataatatgcattcctagttttcagccaagtcggggatgttagtgattgtaccagcccaaagcacttggataatcagggcccttcttccttttataatcaatcatcaacatcagaaaaagctacttgttttatttatattcccttccaaatccgctctggaacatgcagtaactgcaccaaacttattttagtaacaaatatcattggcaactttggaatatatttgatattccattaggatttttctaaaaggggaaataaactatatatatatatgtatcttacccccaattcttccaacagaatttctataggaagccatggatgatggcataagtttgccacatattacatgattttaaataatcctcaaaatacccaaggaactcttaaagagttttggtatgagtatactactttggtttaattttagcttcatggatgttctgcatggaaggatttttgttttccacattttcccattgctagcagagtgaaatccaagagaccaaacatttgcaagcattgtatttgagcacttttgtaaaaaacaaagaaaaagaaaaaaaagaaaatatatataatactaaaaaaaagtatctagaaggctacctcagaatgagactctctaacctacatcagaaccagagaagaatgtgcactatgtgggtctgttatcattattttcttttagtttgtatctttttggagatttatccaagtgccagattactcagtgctataattttcttttagttaaacaaagggggtcagacagacattgcatcatccagacatgccttgttggacatgtagaatccgatggagcactgcacaccagaatgattggccaatgagcagcttctctccctgaaacaataactgcccatttggcaaagggaaagatgacaataatcagaagaagaaaatgaatgggatgcataccatagacgaacgaggcggagactattgcgggaatcttactgttcaggagctgttcctagaactaactcccttactgtcattgatgtgcattccactctgtgcttttctgtacaaccattcaagttttaatttcccaggtgaaccatctttatctgccattaccacaagctttcaagtttccagttattttcatcatcataaccagtacggtgctattatttacctatgtacgtgtagttatgtataattttgtaattagttacaatggtaaaaaaaatcaaaatatataaaaagtgatttgtacagaactttattttagctcttttttaaaaatgatttgcatggttagaaaacggcgaggacagccaggggagggaagggcctctagggaactttgcactttctatacctttgtactatgcactgccctattgattctacacccaataatgatattacttgaacccatctgtaagaaactgcttcggaaattcatttgtgtgtatgtaaataacacaacatagaaacaggaagggaaaaaagtctgcagtaatgcacgtattttttttctttcctgtttattttcggttttgctttaagtccttttatttttaattccctttttgtttttctttttgggttttggttccttttgggtttatgggtgccctgatactccagcagagatcagaaggctacagatccattctatccatccgttatgtggctttgccatcccagcttggagtgtctttacaaagataataacagttgtgttctttgctctcgttttggatgcatagactgaaaaattaaaacaaataacttgtaaaatggcttgttaaaaaatacaattacctctaattagtagtacgcgtaaatgttttacagaatgaaaggcgtgctttttattttcttacttcgttacattggtggcgaaagaagtctgtatgaaaatcagttctttgctgacacaagttccatttgttacaaatgaattctaataaaaatgtcagtgttatgca

SEQ ID NO: 70 - DNA, 1901 bp, Homo sapiens
gggcaggaagacggcgctgcccggaggagcggggcgggcgggcgcgcgggggagcgggcggcgggcgggagccaggcccgggcgggggcgggggcggcggggccagaagaggcggcgggccgcgctccggccggtctgcggcgttggccttggctttggctttggcggcggcggtggagaagatgctgcagtccctggccggcagctcgtgcgtgcgcctggtggagcggcaccgctcggcctggtgcttcggcttcctggtgctgggctacttgctctacctggtcttcggcgcagtggtcttctcctcggtggagctgccctatgaggacctgctgcgccaggagctgcgcaagctgaagcgacgcttcttggaggagcacgagtgcctgtctgagcagcagctggagcagttcctgggccgggtgctggaggccagcaactacggcgtgtcggtgctcagcaacgcctcgggcaactggaactgggacttcacctccgcgctcttcttcgccagcaccgtgctctccaccacaggttatggccacaccgtgcccttgtcagatggaggtaaggccttctgcatcatctactccgtcattggcattcccttcaccctcctgttcctgacggctgtggtccagcgcatcaccgtgcacgtcacccgcaggccggtcctctacttccacatccgctggggcttctccaagcaggtggtggccatcgtccatgccgtgctccttgggtttgtcactgtgtcctgcttcttcttcatcccggccgctgtcttctcagtcctggaggatgactggaacttcctggaatccttttatttttgttttatttccctgagcaccattggcctgggggattatgtgcctggggaaggctacaatcaaaaattcagagagctctataagattgggatcacgtgttacctgctacttggccttattgccatgttggtagttctggaaaccttctgtgaactccatgagctgaaaaaattcagaaaaatgttctatgtgaagaaggacaaggacgaggatcaggtgcacatcatagagcatgaccaactgtccttctcctcgatcacagaccaggcagctggcatgaaagaggaccagaagcaaaatgagccttttgtggccacccagtcatctgcctgcgtggatggccctgcaaaccattgagcgtaggatttgttgcattatgctagagcaccagggtcagggtgcaaggaagaggcttaagtatgttcatttttatcagaatgcaaaagcgaaaattatgtcactttaagaaatagctactgtttgcaatgtcttattaaaaaacaacaaaaaaagacacatggaacaaagaagctgtgaccccagcaggatgtctaatatgtgaggaaatgagatgtccacctaaaattcatatgtgacaaaattatctcgaccttacataggaggagaatacttgaagcagtatgctgctgtggttagaagcagattttatacttttaactggaaactttggggtttgcatttagatcatttagctgatggctaaatagcaaaatttatatttagaagcaaaaaaaaaaagcatagagatgtgttttataaataggtttatgtgtactggtttgcatgtacccacccaaaatgattatttttggagaatctaagtcaaactcactatttataatgcataggtaaccattaactatgtacatataaagtataaatatgtttatattctgtacatatggtttaggtcaccagatcctagtgtagttctgaaactaagactatagatattttgtttcttttgatttctctttatactaaagaatccagagttgctacaataaaataaggggaataataaacttgagagtgaataaccat

SEQ ID NO: 71 - DNA, 2568 bp, Homo sapiens
gccagggaccagtggtgggaggaggctgcggcgctagatgcggacacctggaccgccgcgccgaggctcccggcgctcgctgctcccgcggcccgcgccatgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgcaaagttggcccgagatgaccaaattcacattctcaagcaacaccgacgtaaagaactggaaacacggcaaaaacaatatcgatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagcaagggaacattttcatcgtggactttgagctgctggatggcatcgatgccaacaaaacagacccctgcacactccagttcctggccgctcccatctgcttgctgtataagaacctggccaacaagattgtccccattgccatccagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaagctgctggtggcacacgtgagattcaccattgcaatcaacaccaaggcccgtgagcagctcatctgcgagtgtggcctctttgacaaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgttcacggccgaggtggtagacatctactacgagggcgaccaggtggtggaggaggacccggagctgcaggacttcgtgaacgatgtctacgtgtacggcatgcggggccgcaagtcctcaggcttccccaagtcggtcaagagccgggagcagctgtcggagtacctgaccgtggtgatcttcaccgcctccgcccagcacgccgcggtcaacttcggccagtacgactggtgctcctggatccccaatgcgcccccaaccatgcgagccccgccaccgactgccaagggcgtggtgaccattgagcagatcgtggacacgctgcccgaccgcggccgctcctgctggcatctgggtgcagtgtgggcgctgagccagttccaggaaaacgagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctgagcacactgccagtctcactgtgggaaggccagctgccccagccagatggactccagcctgcctggcaggctgtctggccaggcctcttggcagtcacatctcttcctccgaggccagtacctttccatttattctttgatcttcagggaactgcatagattgatcaaagtgtaaacaccatagggacccattctacacagagcaggactgcacagcgtcctgtccacacccagctcagcatttccacaccaagcagcaacagcaaatcacgaccactgatagatgtctattcttgttggagacatgggatgattattttctgttctatttgtgcttagtccaattccttgcacatagtaggtacccaattcaattactattgaatgaattaagaattggttgccataaaaataaatcagttcatttaaaaaaaaaaaaaaaaaa

SEQ ID NO: 72 - DNA, 1172 bp, Homo sapiens
gagacattcctcaattgcttagacatattctgagcctacagcagaggaacctccagtctcagcaccatgaatcaaactgcgattctgatttgctgccttatctttctgactctaagtggcattcaaggagtacctctctctagaaccgtacgctgtacctgcatcagcattagtaatcaacctgttaatccaaggtctttagaaaaacttgaaattattcctgcaagccaattttgtccacgtgttgagatcattgctacaatgaaaaagaagggtgagaagagatgtctgaatccagaatcgaaggccatcaagaatttactgaaagcagttagcaaggaaatgtctaaaagatctccttaaaaccagaggggagcaaaatcgatgcagtgcttccaaggatggaccacacagaggctgcctctcccatcacttccctacatggagtatatgtcaagccataattgttcttagtttgcagttacactaaaaggtgaccaatgatggtcaccaaatcagctgctactactcctgtaggaaggttaatgttcatcatcctaagctattcagtaataactctaccctggcactataatgtaagctctactgaggtgctatgttcttagtggatgttctgaccctgcttcaaatatttccctcacctttcccatcttccaagggtactaaggaatctttctgctttggggtttatcagaattctcagaatctcaaataactaaaaggtatgcaatcaaatctgctttttaaagaatgctctttacttcatggacttccactgccatcctcccaaggggcccaaattctttcagtggctacctacatacaattccaaacacatacaggaaggtagaaatatctgaaaatgtatgtgtaagtattcttatttaatgaaagactgtacaaagtataagtcttagatgtatatatttcctatattgttttcagtgtacatggaataacatgtaattaagtactatgtatcaatgagtaacaggaaaattttaaaaatacagatagatatatgctctgcatgttacataagataaatgtgctgaatggttttcaaataaaaatgaggtactctcctggaaatattaagaaagactatctaaatgttgaaagatcaaaaggttaataaagtaattataact

SEQ ID NO: 73 - DNA, 3226 bp, Homo sapiens
cgcgagctaagcaggaggcggaggcggaggcggagggcgaggggcggggagcgccgcctggagcgcggcaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcagatgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggatcgtgggcggtgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaatccacatggtcttcgtccttgacgtcgttttacaagaaaacaatggggctggttttgcttccccgtgcatgatttactcttagagatgattcagaggtcacttcatttttattaaacagtgaacttgtctggctttggcactctctgccattctgtgcaggctgcagtggctcccctgcccagcctgctctccctaaccccttgtccgcaaggggtgatggccggctggttgtgggcactggcggtcaagtgtggaggagaggggtggaggctgccccattgagatcttcctgctgagtcctttccaggggccaattttggatgagcatggagctgtcacctctcagctgctggatgacttgagatgaaaaaggagagacatggaaagggagacagccaggtggcacctgcagcggctgccctctggggccacttggtagtgtccccagcctacctctccacaaggggattttgctgatgggttcttagagccttagcagccctggatggtggccagaaataaagggaccagcccttcatgggtggtgacgtggtagtcacttgtaaggggaacagaaacatttttgttcttatggggtgagaatatagacagtgcccttggtgcgagggaagcaattgaaaaggaacttgccctgagcactcctggtgcaggtctccacctgcacattgggtggggctcctgggagggagactcagccttcctcctcatcctccctgaccctgctcctagcaccctggagagtgcacatgccccttggtcctggcagggcgccaagtctggcaccatgttggcctcttcaggcctgctagtcactggaaattgaggtccatgggggaaatcaaggatgctcagtttaaggtacactgtttccatgttatgtttctacacattgctacctcagtgctcctggaaacttagcttttgatgtctccaagtagtccaccttcatttaactctttgaaactgtatcacctttgccaagtaagagtggtggcctatttcagctgctttgacaaaatgactggctcctgacttaacgttctataaatgaatgtgctgaagcaaagtgcccatggtggcggcgaagaagagaaagatgtgttttgttttggactctctgtggtcccttccaatgctgtgggtttccaaccaggggaagggtcccttttgcattgccaagtgccataaccatgagcactactctaccatggttctgcctcctggccaagcaggctggtttgcaagaatgaaatgaatgattctacagctaggacttaaccttgaaatggaaagtcttgcaatcccatttgcaggatccgtctgtgcacatgcctctgtagagagcagcattcccagggaccttggaaacagttggcactgtaaggtgcttgctccccaagacacatcctaaaaggtgttgtaatggtgaaaacgtcttccttctttattgccccttcttatttatgtgaacaactgtttgtctttttttgtatcttttttaaactgtaaagttcaattgtgaaaatgaatatcatgcaaataaattatgcgatttttttttcaaagcaaaaaaaaaaaaaaaaaaaaaaaaaaaaaaa

SEQ ID NO: 74 - DNA, 1270 bp, Homo sapiens
attttctaaaagggacagagagcaccctgctacatttcctaatcaagaagttggcgtgcagctgggagagctagactaagttggtcatgatgcagaagctactcaaatgcagtcggcttgtcctggctcttgccctcatcctggttctggaatcctcagttcaaggttatcctacgcggagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgggacaaagaattttatagaaatttttaaacatctgaaaaagaagcttaagttttatcatccttttttttctcatgaattcttaaaggattatgctttaatgctgttatctattttattgttcttgaaaatacctgcattttttggtatcatgttcaaccaacatcattatgaaattaattagattcccatggccataaaatggctttaaagaatatatatatatttttaaagtagcttgagaagcaaattggcaggtaatatttcatacctaaattaagactctgacttggattgtgaattataatgatatgccccttttcttataaaaacaaaaaaaaaaataatgaaacacagtgaatttgtagagtgggggtatttgacatattttacagggtggagtgtactatatactattacctttgaatgtgtttgcagagctagtggatgtgtttgtctacaagtatgattgctgttacataacaccccaaattaactcccaaattaaaacacagttgtgctgtcaatacctcatactgctttacctttttttcctggatatctgtgtattttcaaatgttactatatattaaagcagaaatataaccaaaggttaaaaaaaaaaaaaaaaaa

SEQ ID NO: 75 - DNA, 1542 bp, Homo sapiens
acaattactctacagctcagaacaccaactgctgaggctgccttgggaagaggatgatcctaaacaaagctctgctgctgggggccctcgctctgaccaccgtgatgagcccctgtggaggtgaagacattgtggctgaccacgttgcctcttgtggtgtaaacttgtaccagttttacggtccctctggccagtacacccatgaatttgatggagatgagcagttctacgtggacctggagaggaaggagactgcctggcggtggcctgagttcagcaaatttggaggttttgacccgcagggtgcactgagaaacatggctgtggcaaaacacaacttgaacatcatgattaaacgctacaactctaccgctgctaccaatgaggttcctgaggtcacagtgttttccaagtctcccgtgacactgggtcagcccaacaccctcatttgtcttgtggacaacatctttcctcctgtggtcaacatcacatggctgagcaatgggcagtcagtcacagaaggtgtttctgagaccagcttcctctccaagagtgatcattccttcttcaagatcagttacctcaccttcctcccttctgctgatgagatttatgactgcaaggtggagcactggggcctggaccagcctcttctgaaacactgggagcctgagattccagcccctatgtcagagctcacagagactgtggtctgtgccctggggttgtctgtgggcctcatgggcattgtggtgggcactgtcttcatcatccaaggcctgcgttcagttggtgcttccagacaccaagggccattgtgaatcccatcctggaagggaaggtgcatcgccatctacaggagcagaagaatggacttgctaaatgacctagcactattctctggcccgatttatcatatcccttttctcctccaaatatttctcctctcaccttttctctgggacttaagctgctatatcccctcagagctcacaaatgcctttacattctttccctgacctcctgattttttttttcttttctcaaatgttacctacaaagacatgcctggggtaagccacccggctacctaattcctcagtaacctccatctaaaatctccaaggaagcaataaattccttttatgagatctatgtcaaatttttccatctttcatccagggctgactgaaactatggctaataattggggtactcttatgtttcaatccaatttaacctcatttcccagatcatttttcatgtccagtaacacagaagccaccaagtacagtatagcctgataatatgttgatttcttagctgacattaatatttcttgcttccttgtgttcccacccttggcactgccacccacccctcaattcaggcaacaatgaaattaatggataccgtctgcccttggcccagaattgttatagcaaaaattttagaaccaaaaaataagtctgtactaatttcaatgtggcttttaaaagtatgacagagaaataagttaggataaaggaaatttgaatctca

SEQ ID NO: 76 - DNA, 3447 bp, Homo sapiens
ggccagtccgcccggcggctcgcgcacggctccgcggtcccttttgcctgtccagccggccgcctgtccctgctccctccctccgtgaggtgtccgggttcccttcgcccagctctcccacccctacccgaccccggcgcccgggctcccagagggaactgcacttcggcagagttgaatgaatgaagagagacgcggagaactcctaaggaggagattggacaggctggactccccattgcttttctaaaaatcttggaaactttgtccttcattgaattacgacactgtccacctttaatttcctcgaaaacgcctgtaactcggctgaagccatgccttgtgttcaggcgcagtatgggtcctcgcctcaaggagccagccccgcttctcagagctacagttaccactcttcgggagaatacagctccgatttcttaactccagagtttgtcaagtttagcatggacctcaccaacactgaaatcactgccaccacttctctccccagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtccaacccagtggagggtaaactcatcttttgcaatggggtggtcttgcacaggttgcaatgcgttcgtggctttggggaatggattgattccattgttgaattctcctccaacttgcagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataatgtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtttgcaaaaaaaaagaaaataaatacataaaaaagggacaagcatgttgattctaggttgaaaatgttataggcacttgctacttcagtaatgtctatattatataaatagtatttcagacactatgtagtctgttagattttataaagattggtagttatctgagcttaaacattttctcaattgtaaaataggtgggcacaagtattacacatcagaaaatcctgacaaaagggacacatagtgtttgtaacaccgtccaacattccttgtttgtaagtgttgtatgtaccgttgatgttgataaaaagaaagtttatatcttgattattttgttgtctaaagctaaacaaaacttgcatgcagcagcttttgactgtttccagagtgcttataatatacataactccctggaaataactgagcactttgaattttttttatgtctaaaattgtcagttaatttattattttgtttgagtaagaattttaatattgccatattctgtagtatttttctttgtatatttctagtatggcacatgatatgagtcactgcctttttttctatggtgtatgacagttagagatgctgattttttttctgataaattctttctttgagaaagacaattttaatgtttacaacaataaaccatgtaaatgaaaaaaaaaa

SEQ ID NO: 77 - DNA, 6216 bp, Homo sapiens; identical to SEQ ID NO: 50

SEQ ID NO: 78 - DNA, 768 bp, Homo sapiens
ccttcagcataaaagctgatccacaaacaagaggagcaccagacctcctcttggcttcgagatggcttcgccacaccaagagcccaaacctggagacctgattgagattttccgccttggctatgagcactgggccctgtatataggagatggctacgtgatccatctggctcctccaagtgagtaccccggggctggctcctccagtgtcttctcagtcctgagcaacagtgcagaggtgaaacgggggcgcctggaagatgtggtgggaggctgttgctatcgggtcaacaacagcttggaccatgagtaccaaccacggcccgtggaggtgatcatcagttctgcgaaggagatggttggtcagaagatgaagtacagtattgtgagcaggaactgtgagcactttgtcgcccagctgagatatggcaagtcccgctgtaaacaggtggaaaaggccaaggttgaagtcggtgtggccacggcgcttggaatcctggttgttgctggatgctcttttgcgattaggagataccaaaaaaaagcaacagcctgaagcagccacaaaatcctgtgttagaagcagctgtgggggtcccagtggagatgagcctcccccatgcctccagcagcctgaccctcgtgccctgtctcaggcgttctctagatcctttcctctgtttccctctctcgctggcaaaagtatgatctaattgaaacaagactgaaggatcaataaacagccatctgccccttcaaaaaaaaaaa

SEQ ID NO: 79 - DNA, 1336 bp, Homo sapiens; identical to SEQ ID NO: 54

SEQ ID NO: 80 - DNA, 2052 bp, Homo sapiens
tgtgtgtgtgctcacacccacacgtgtgactttgcacgcatttgtctttgagagagagataatagtttttgtttttctttcagtagccaaagtttaaaccattgctttttctttgattctatcgcttttaaggtgatctttcttaacacaggataagaaagcagtaatgtcctaaagaatgctgttgaattaattagtatcagcctctcctacagttctggaaggatacgtggttaagtaccactcctggatgaatcagaaaaacagccacttgagcaatttcgtgttctgtggttcagatgagaatcccagttgagaaagtaagaaaatatgtgtttattcttcagctttaaattgttatatcacaaacttccttcctccttggcaagctttcttttttgacgagaagaaaattgtaataaacaacagtatgactaatagatagtcacatggttacttccagtttgcaaaatgctatttatactttgagttactcttcaaaagtggtatacctctagtttggagctgtgctgtaaaaacaagagtaacatttttatattaaagttaaataaagttacaactttgaagagagtttctgcaagacatgacacaaagctgctagcagaaaatcaaaacgctgattaaaagaagcacggtatgatgaccaaacataaaaagtgttttataattgttggtgttttaataacaactaatattattactctgatagttaaactaactcgagattctcagagtttatgcccctatgattggattggtttccaaaacaaatgctattatttctctaaagaagaaggagattggaattcaagtaaatacaactgttccactcaacatgccgacctaactataattgacaacatagaagaaatgaattttcttaggcggtataaatgcagttctgatcactggattggactgaagatggcaaaaaatcgaacaggacaatgggtagatggagctacatttaccaaatcgtttggcatgagagggagtgaaggatgtgcctacctcagcgatgatggtgcagcaacagctagatgttacaccgaaagaaaatggatttgcaggaaaagaatacactaagttaatgtctaagataatggggaaaatagaaaataacattattaagtgtaaaaccagcaaagtacttttttaattaaacaaagttcgagttttgtacctgtctggttaattctgcttacgtgtcaggctacacataaaagccacttcaaagattggcaaaaaatggttacaggtattctgctgagtttttttctttctttctttctctctctctctttctttctttctttctttctttctttttttaactgtaaaccagaaaacaattgtggggatcaaggacagacatagcacttagacaggactttcatgacccaatatggaacaatttgagtaccagaataggagattatggcctattgaacaaaatgtgaaactgggagtccacaaagacataaatggaaagatgaagtacctcctgacagagcaagaatggcactgaacaatgttatatggacaatggctattttattcaagactattacaatagggaaaagagactaggactcagtctgaactgaaatctgtcaaaacaaaggggggtggggctttaagagtgaaggtgaggaggagatcacacaccgtatgtgtttgctaactggctttacccaaaagaaaattaaactttctttgatctgtacaagttgatcaaacaaatggggtcattcttgtcatatgcaactaaaacagggtagacaggccaggggaaaaaggcactcagggcacacagcattgcttcaaaatataattctctacaaacctagttgctaaaactacctgttgtaacctaaaaccagttttatctaacagctattaaaacaacctactgtgactgcaaaactggttttacccaccactgtcacacaccaatcagaacttgccagctcctcaaaactttactagggccaataaactttctttcaaaacaataaaaaaaaaaaaaaa

SEQ ID NO: 81 - DNA, 8368 bp, Homo sapiens
gcgatccgggcgccaccccgcggtcatcggtcaccggtcgctctcaggaacagcagcgcaacctctgctccctgcctcgcctcccgcgcgcctaggtgcctgcgactttaattaaagggccgtcccctcgccgaggctgcagcaccgcccccccggcttctcgcgcctcaaaatgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcgacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggcctgtgtcctgactgggactcttgggacgccagcaagcccgttaccaatgcgcgagaggccatgcagcaggcggatgactggctgggcatcccccaggtgatcacccccgaggagattgtggaccccaacgtggacgagcactctgtcatgacctacctgtcccagttccccaaggccaagctgaagccaggggctcccttgcgccccaaactgaacccgaagaaagcccgtgcctacgggccaggcatcgagcccacaggcaacatggtgaagaagcgggcagagttcactgtggagaccagaagtgctggccagggagaggtgctggtgtacgtggaggacccggccggacaccaggaggaggcaaaagtgaccgccaataacgacaagaaccgcaccttctccgtctggtacgtccccgaggtgacggggactcataaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccaagggagaggagcgcgtgaagcagaaggacctgggggatggcgtgtatggcttcgagtattaccccatggtccctggaacctatatcgtcaccatcacgtggggtggtcagaacatcgggcgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtgaaggcacgtgggcctggattggagaagacaggtgtggccgtcaacaagccagcagagttcacagtggatgccaagcacggtggcaaggccccacttcgggtccaagtccaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgaatgtgggagctggcagccaccccaacaaggtcaaagtatacggccccggagtagccaagacagggctcaaggcccacgagcccacctacttcactgtggactgcgccgaggctggccagggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggccacgcccaccagccccatccgagtcaaggtggagccctctcatgacgccagtaaggtgaaggccgagggccctggcctcagtcgcactggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcagggtccagtaggcgtcaatgtcacttatggaggggatcccatccctaagagccctttctcagtggcagtatctccaagcctggacctcagcaagatcaaggtgtctggcctgggagagaaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggcctggtggagccagtggacgtggtagacaacgctgatggcacccagaccgtcaattatgtgcccagccgagaagggccctacagcatctcagtactgtatggagatgaagaggtaccccggagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacagtgtcaatcggaggtcacgggctaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggctctggctggggaccagccctcggtgcagccccctctacggtctcagcagctggccccacagtacacctacgcccagggcggccagcagacttgggccccggagaggcccctggtgggtgtcaatgggctggatgtgaccagcctgaggccctttgaccttgtcatccccttcaccatcaagaagggcgagatcacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggaagccccttgcagttctatgtggattacgtcaactgtggccatgtcactgcctatgggcctggcctcacccatggagtagtgaacaagcctgccaccttcaccgtcaacaccaaggatgcaggagaggggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtggggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggcagccccttctctgtgaaggtgacaggcgagggccgggtgaaagagagcatcacccgcaggcgtcgggctccttcagtggccaacgttggtagtcattgtgacctcagcctgaaaatccctgaaattagcatccaggatatgacagcccaggtgaccagcccatcgggcaagacccatgaggccgagatcgtggaaggggagaaccacacctactgcatccgctttgttcccgctgagatgggcacacacacagtcagcgtcaagtacaagggccagcacgtgcctgggagccccttccagttcaccgtggggcccctaggggaagggggagcccacaaggtccgagctgggggccctggcctggagagagctgaagctggagtgccagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtgactacgaagtctcagtcaagttcaacgaggaacacattcccgacagccccttcgtggtgcctgtggcttctccgtctggcgacgcccgccgcctcactgtttctagccttcaggagtcagggctaaaggtcaaccagccagcctcttttgcagtcagcctgaacggggccaagggggcgatcgatgccaaggtgcacagcccctcaggagccctggaggagtgctatgtcacagaaattgaccaagataagtatgctgtgcgcttcatccctcgggagaatggcgtttacctgattgacgtcaagttcaacggtacccacatccctggaagccccttcaagatccgagttggggagcctgggcatggaggggacccaggcttggtgtctgcttacggagcaggtctggaaggcggtgtcacagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatgggggcacgagcacatcccaggcagcccctaccgcgttgtggtgccctgagtctggggcccgtgccagccggcagcccccaagcctgccccgctacccaagcagccccgccctcttcccctcaaccccggcccaggccgccctggccgcccgcctgtcactgcagctgcccctgccctgtgccgtgctgcgctcacctgcctccccagccagccgctgacctctcggctttcacttgggcagagggagccatttggtggcgctgcttgtcttctttggttctgggaggggtgagggatgggg

SEQ ID NO: 82 - DNA, 2475 bp, Homo sapiens
gtgcagaaggcacgaggaagccacagtgctccggatcctccaatcttcgctcctccaatctccgctcctccacccagttcaggaacccgcgaccgctcgcagcgctctcttgaccactatgagcctcctgtccagccgcgcggcccgtgtccccggtccttcgagctccttgtgcgcgctgttggtgctgctgctgctgctgacgcagccagggcccatcgccagcgctggtcctgccgctgctgtgttgagagagctgcgttgcgtttgtttacagaccacgcaaggagttcatcccaaaatgatcagtaatctgcaagtgttcgccataggcccacagtgctccaaggtggaagtggtagcctccctgaagaacgggaaggaaatttgtcttgatccagaagccccttttctaaagaaagtcatccagaaaattttggacggtggaaacaaggaaaactgattaagagaaatgagcacgcatggaaaagtttcccagtcttcagcagagaagttttctggaggtctctgaacccagggaagacaagaaggaaagattttgttgttgtttgtttatttgtttttccagtagttagctttcttcctggattcctcactttgaagagtgtgaggaaaacctatgtttgccgcttaagctttcagctcagctaatgaagtgtttagcatagtacctctgctatttgctgttattttatctgctatgctattgaagttttggcaattgactatagtgtgagccaggaatcactggctgttaatctttcaaagtgtcttgaattgtaggtgactattatatttccaagaaatattccttaagatattaactgagaaggctgtggatttaatgtggaaatgatgtttcataagaattctgttgatggaaatacactgttatcttcacttttataagaaataggaaatattttaatgtttcttggggaatatgttagagaatttccttactcttgattgtgggatactatttaattatttcactttagaaagctgagtgtttcacaccttatctatgtagaatatatttccttattcagaatttctaaaagtttaagttctatgagggctaatatcttatcttcctataattttagacattctttatctttttagtatggcaaactgccatcatttacttttaaactttgattttatatgctatttattaagtattttattaggagtaccataattctggtagctaaatatatattttagatagatgaagaagctagaaaacaggcaaattcctgactgctagtttatatagaaatgtattcttttagtttttaaagtaaaggcaaacttaacaatgacttgtactctgaaagttttggaaacgtattcaaacaatttgaatataaatttatcatttagttataaaaatatatagcgacatcctcgaggccctagcatttctccttggataggggaccagagagagcttggaatgttaaaaacaaaacaaaacaaaaaaaaacaaggagaagttgtccaagggatgtcaattttttatccctctgtatgggttagattttccaaaatcataatttgaagaaggccagcatttatggtagaatatataattatatataaggtggccacgctggggcaagttccctccccactcacagctttggcccctttcacagagtagaacctgggttagaggattgcagaagacgagcggcagcggggagggcagggaagatgcctgtcgggtttttagcacagttcatttcactgggattttgaagcatttctgtctgaatgtaaagcctgttctagtcctggtgggacacactggggttgggggtgggggaagatgcggtaatgaaaccggttagtcagtgttgtcttaatatccttgataatgctgtaaagtttatttttacaaatatttctgtttaagctatttcacctttgtttggaaatccttcccttttaaagagaaaatgtgacacttgtgaaaaggcttgtaggaaagctcctccctttttttctttaaacctttaaatgacaaacctaggtaattaatggttgtgaatttctatttttgctttgtttttaatgaacatttgtctttcagaataggattctgtgataatatttaaatggcaaaaacaaaacataattttgtgcaattaacaaagctactgcaagaaaaataaaacatttcttggtaaaaacgtatgtatttatatattatatatttatatataatatatattatatatttagcattgctgagctttttagatgcctattgtgtatcttttaaaggttttgaccattttgttatgagtaattacatatatattacattcactatattaaaattgtacttttttactatgtgtctcattggttcatagtctttattttgtcctttgaataaacattaaaagatttctaaacttcaaaaaaaaaaaaaaaaaa

SEQ ID NO: 83 - DNA, 4125 bp, Homo sapiens
cggctatccgcgcgggagtgcgccacgcggggccggagcgcctattagccgccaggacctcggagcgccccgaccacccctgagcccctctggcttcggagccccccagcaccccttcccgggtcccctcgcccaccctaatccactctccctccctttcccggattccctcgctcaccccatcctctctcccgccccttcctggattccctcacccgtctcgatcccctctccgccctttcccagagacccagagcccctgaccccccgcgccctccccggagccccccgcgcgtgccgcggccatggcggccgtgcgcggggcgcccctgctcagctgcctcctggcgttgctggccctgtgccctggagggcgcccgcagacggtgctgaccgacgacgagatcgaggagttcctcgagggcttcctgtcagagctagaacctgagccccgggaggacgacgtggaggccccgccgcctcccgagcccaccccgcgggtccgaaaagcccaggcggggggcaagccagggaagcggccagggacggccgcagaagtgcctccggaaaagaccaaagacaaagggaagaaaggcaagaaagacaaaggccccaaggtgcccaaggagtccttggaggggtcccccaggccgcccaagaaggggaaggagaagccacccaaggccaccaagaagcccaaggagaagccacctaaggccaccaagaagcccaaggagaagccacccaaggccaccaagaagcccaaagagaagccacccaaggccaccaagaagcccccgtcagggaagaggccccccattctggctccctcagaaaccctggagtggccactgcccccaccccccagccctggccccgaggagctaccccaggagggaggggcgcccctctcaaataactggcagaatccaggagaggagacccatgtggaggcacgggagcaccagcctgagccggaggaggagaccgagcaacccacactggactacaatgaccagatcgagagggaggactatgaggactttgagtacattcggcgccagaagcaacccaggccacccccaagcagaaggaggaggcccgagcgggtctggccagagccccctgaggagaaggccccggccccagccccggaggagaggattgagcctcctgtgaagcctctgctgcccccgctgccccctgactatggtgatggttacgtgatccccaactacgatgacatggactattactttgggcctcctccgccccagaagcccgatgctgagcgccagacggacgaagagaaggaggagctgaagaaacccaaaaaggaggacagcagccccaaggaggagaccgacaagtgggcagtggagaagggcaaggaccacaaagagccccgaaagggcgaggagttggaggaggagtggacgcctacggagaaagtcaagtgtccccccattgggatggagtcacaccgtattgaggacaaccagatccgagcctcctccatgctgcgccacggcctgggggcacagcgcggccggctcaacatgcagaccggtgccactgaggacgactactatgatggtgcgtggtgtgccgaggacgatgccaggacccagtggatagaggtggacaccaggaggactacccggttcacaggcgtcatcacccagggcagagactccagcatccatgacgattttgtgaccaccttcttcgtgggcttcagcaatgacagccagacatgggtgatgtacaccaacggctatgaggaaatgacctttcatgggaacgtggacaaggacacacccgtgctgagtgagctcccagagccggtggtggctcgtttcatccgcatctacccactcacctggaatggcagcctgtgcatgcgcctggaggtgctggggtgctctgtggcccctgtctacagctactacgcacagaatgaggtggtggccaccgatgacctggatttccggcaccacagctacaaggacatgcgccagctcatgaaggtggtgaacgaggagtgccccaccatcacccgcacttacagcctgggcaagagctcacgaggcctcaagatctatgccatggagatctcagacaaccctggggagcatgaactgggggagcccgagttccgctacactgctgggatccatggcaacgaggtgctgggccgagagctgttgctgctgctcatgcagtacctgtgccgagagtaccgcgatgggaacccacgtgtgcgcagcctggtgcaggacacacgcatccacctggtgccctcactgaaccctgatggctacgaggtggcagcgcagatgggctcagagtttgggaactgggcgctgggactgtggactgaggagggctttgacatctttgaagatttcccggatctcaactctgtgctctggggagctgaggagaggaaatgggtcccctaccgggtccccaacaataacttgcccatccctgaacgctacctttcgccagatgccacggtatccacggaggtccgggccatcattgcctggatggagaagaaccccttcgtgctgggagcaaatctgaacggcggcgagcggctagtatcctacccctacgatatggcccgcacgcctacccaggagcagctgctggccgcagccatggcagcagcccggggggaggatgaggacgaggtctccgaggcccaggagactccagaccacgccatcttccggtggcttgccatctccttcgcctccgcacacctcaccttgaccgagccctaccgcggaggctgccaagcccaggactacaccggcggcatgggcatcgtcaacggggccaagtggaacccccggaccgggactatcaatgacttcagttacctgcataccaactgcctggagctctccttctacctgggctgtgacaagttccctcatgagagtgagctgccccgcgagtgggagaacaacaaggaggcgctgctcaccttcatggagcaggtgcaccgcggcattaagggggtggtgacggacgagcaaggcatccccattgccaacgccaccatctctgtgagtggcattaatcacggcgtgaagacagccagtggtggtgattactggcgaatcttgaacccgggtgagtaccgcgtgacagcccacgcggagggctacaccccgagcgccaagacctgcaatgttgactatgacatcggggccactcagtgcaacttcatcctggctcgctccaactggaagcgcatccgggagatcatggccatgaacgggaaccggcctatcccacacatagacccatcgcgccctatgaccccccaacagcgacgcctgcagcagcgacgcctacaacaccgcctgcggcttcgggcacagatgcggctgcggcgcctcaacgccaccaccaccctaggcccccacactgtgcctcccacgctgccccctgcccctgccaccaccctgagcactaccatagagccctggggcctcataccgccaaccaccgctggctgggaggagtcggagactgagacctacacagaggtggtgacagagtttgggaccgaggtggagcccgagtttgggaccaaggtggagcccgagtttgagacccagttggagcctgagtttgagacccagctggaacccgagtttgaggaagaggaggaggaggagaaagaggaggagatagccactggccaggcattccccttcacaacagtagagacctacacagtgaactttggggacttctgagatcagcgtcctaccaagaccccagcccaactcaagctacagcagcagcacttcccaagcctgctgaccacagtcacatcacccatcagcacatggaaggcccctggtatggacactgaaaggaagggctggtcctgcccctttgagggggtgcaaacatgactgggacctaagagccagaggctgtgtagaggctcctgctccacctgccagtctcgtaagagatggggttgctgcagtgttggagtaggggcagagggagggagccaaggtcactccaataaaacaagctcatggcaaaaaaaaaaaaaaaaaaaaaaaaaaaaaaaaaaaaaaaaaaaaa

SEQ ID NO: 84 - DNA, 2401 bp, Homo sapiens
agcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcgggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaacaacgacatctccgagctccgcaaggatgacttcaagggtctccagcacctctacgccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgactggcatccccaaagacctccctgagaccctgaatgaactccacctagaccacaacaaaatccaggccatcgaactggaggacctgcttcgctactccaagctgtacaggctgggcctaggccacaaccagatcaggatgatcgagaacgggagcctgagcttcctgcccaccctccgggagctccacttggacaacaacaagttggccagggtgccctcagggctcccagacctcaagctcctccaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcggtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtgaaaaaaaaaaaaaaaaaaaaa

SEQ ID NO: 85 - DNA, 5699 bp, Homo sapiens
ggagttctcagacctccagtttcagccctgccctcagcctccaatccgtaagagacacccagccccagcaattggattgggcagcccgtcttgacacaccactgtgctgagtgcttgaggacgtgtttcaacagatggttggggttagtgtgtgtcatcacattcgagtggggattaagagaaggaaggctgccttgctggagctgtgtggtcttctccaagtgagagtcgcaggcaatagaactactttgcttttggaggaaaaggaggaattcattttcagcagacacaagaaaagcagtttttttttcagggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcctaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatgaagattgcctgctctctctgtgcctagcctcaaagcgttcatcatacatcatacctttaagattgctatattttgggttattttcttgacaggagaaaaagatctaaagatcttttattttcatcttttttggttttcttggcatgactaagaagcttaaatgttgataaaatatgactagttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttcaagttattaggaagcatactctgttttttaatcatgtataatattccatgatacttttatagaacaattctggcttcaggaaagtctagaagcaatatttcttcaaataaaaggtgtttaaacttt

SEQ ID NO: 86 - DNA, 3439 bp, Homo sapiens
gcgcccgcgcctcgggccgtcgggagcggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcaaccaggacaccatcaaccgcatcatcaaggtcatgaaacacgaagcctacggagagtgctacaaggtgagctgcctggaaatccctgggccctctgggcccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacaatggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgagggcccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacatatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgatcgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacagagctgtccgtggcacagtgcacgcagcggcccgtggacatcgtcttcctgctggacggctccgagcggctgggtgagcagaacttccacaaggcccggcgcttcgtggagcaggtggcgcggcggctgacgctggcccggagggacgacgaccctctcaacgcacgcgtggcgctgctgcagtttggtggccccggcgagcagcaggtggccttcccgctgagccacaacctcactgccatccacgaggcgctggagaccacacaatacctgaactccttctcgcacgtgggcgcaggcgtggtgcacgccatcaatgccatcgtgcgcagcccgcgtggcggggcccggaggcacgcagagctgtccttcgtgttcctcacggacggcgtcacgggcaacgacagtctgcacgagtcggcgcactccatgcgcaagcagaacgtggtacccaccgtgctggccttgggcagcgacgtggacatggacgtgctcaccacgctcagcctgggtgaccgcgccgccgtgttccacgagaaggactatgacagcctggcgcaacccggcttcttcgaccgcttcatccgctggatctgctagcgccgccgcccgggccccgcagtcgagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccaaaaaaaaaaa

SEQ ID NO: 87 - DNA, 5826 bp, Homo sapiens
gaggaggagacggcatccagtacagaggggctggacttggacccctgcagcagccctgcacaggagaagcggcatataaagccgcgctgcccgggagccgctcggccacgtccaccggagcatcctgcactgcagggccggtctctcgctccagcagagcctgcgcctttctgactcggtccggaacactgaaaccagtcatcactgcatctttttggcaaaccaggagctcagctgcaggaggcaggatggtctggaggctggtcctgctggctctgtgggtgtggcccagcacgcaagctggtcaccaggacaaagacacgaccttcgaccttttcagtatcagcaacatcaaccgcaagaccattggcgccaagcagttccgcgggcccgaccccggcgtgccggcttaccgcttcgtgcgctttgactacatcccaccggtgaacgcagatgacctcagcaagatcaccaagatcatgcggcagaaggagggcttcttcctcacggcccagctcaagcaggacggcaagtccaggggcacgctgttggctctggagggccccggtctctcccagaggcagttcgagatcgtctccaacggccccgcggacacgctggatctcacctactggattgacggcacccggcatgtggtctccctggaggacgtcggcctggctgactcgcagtggaagaacgtcaccgtgcaggtggctggcgagacctacagcttgcacgtgggctgcgacctcatagacagcttcgctctggacgagcccttctacgagcacctgcaggcggaaaagagccggatgtacgtggccaaaggctctgccagagagagtcacttcaggggtttgcttcagaacgtccacctagtgtttgaaaactctgtggaagatattctaagcaagaagggttgccagcaaggccagggagctgagatcaacgccatcagtgagaacacagagacgctgcgcctgggtccgcatgtcaccaccgagtacgtgggccccagctcggagaggaggcccgaggtgtgcgaacgctcgtgcgaggagctgggaaacatggtccaggagctctcggggctccacgtcctcgtgaaccagctcagcgagaacctcaagagagtgtcgaatgataaccagtttctctgggagctcattggtggccctcctaagacaaggaacatgtcagcttgctggcaggatggccggttctttgcggaaaatgaaacgtgggtggtggacagctgcaccacgtgtacctgcaagaaatttaaaaccatttgccaccaaatcacctgcccgcctgcaacctgcgccagtccatcctttgtggaaggcgaatgctgcccttcctgcctccactcggtggacggtgaggagggctggtctccgtgggcagagtggacccagtgctccgtgacgtgtggctctgggacccagcagagaggccggtcctgtgacgtcaccagcaacacctgcttggggccctccatccagacacgggcttgcagtctgagcaagtgtgacacccgcatccggcaggacggcggctggagccactggtcaccttggtcttcatgctctgtgacctgtggagttggcaatatcacacgcatccgtctctgcaactccccagtgccccagatggggggcaagaattgcaaagggagtggccgggagaccaaagcctgccagggcgccccatgcccaatcgatggccgctggagcccctggtccccgtggtcggcctgcactgtcacctgtgccggtgggatccgggagcgcacccgggtctgcaacagccctgagcctcagtacggagggaaggcctgcgtgggggatgtgcaggagcgtcagatgtgcaacaagaggagctgccccgtggatggctgtttatccaacccctgcttcccgggagcccagtgcagcagcttccccgatgggtcctggtcatgcggctcctgccctgtgggcttcttgggcaatggcacccactgtgaggacctggacgagtgtgccctggtccccgacatctgcttctccaccagcaaggtgcctcgctgtgtcaacactcagcctggcttccactgcctgccctgcccgccccgatacagagggaaccagcccgtcggggtcggcctggaagcagccaagacggaaaagcaagtgtgtgagcccgaaaacccatgcaaggacaagacacacaactgccacaagcacgcggagtgcatctacctgggccacttcagcgaccccatgtacaagtgcgagtgccagacaggctacgcgggcgacgggctcatctgcggggaggactcggacctggacggctggcccaacctcaatctggtctgcgccaccaacgccacctaccactgcatcaaggataactgcccccatctgccaaattctgggcaggaagactttgacaaggacgggattggcgatgcctgtgatgatgacgatgacaatgacggtgtgaccgatgagaaggacaactgccagctcctcttcaatccccgccaggctgactatgacaaggatgaggttggggaccgctgtgacaactgcccttacgtgcacaaccctgcccagatcgacacagacaacaatggagagggtgacgcctgctccgtggacattgatggggacgatgtcttcaatgaacgagacaattgtccctacgtctacaacactgaccagagggacacggatggtgacggtgtgggggatcactgtgacaactgccccctggtgcacaaccctgaccagaccgacgtggacaatgaccttgttggggaccagtgtgacaacaacgaggacatagatgacgacggccaccagaacaaccaggacaactgcccctacatctccaacgccaaccaggctgaccatgacagagacggccagggcgacgcctgtgaccctgatgatgacaacgatggcgtccccgatgacagggacaactgccggcttgtgttcaacccagaccaggaggacttggacggtgatggacggggtgatatttgtaaagatgattttgacaatgacaacatcccagatattgatgatgtgtgtcctgaaaacaatgccatcagtgagacagacttcaggaacttccagatggtccccttggatcccaaagggaccacccaaattgatcccaactgggtcattcgccatcaaggcaaggagctggttcagacagccaactcggaccccggcatcgctgtaggttttgacgagtttgggtctgtggacttcagtggcacattctacgtaaacactgaccgggacgacgactatgccggcttcgtctttggttaccagtcaagcagccgcttctatgtggtgatgtggaagcaggtgacgcagacctactgggaggaccagcccacgcgggcctatggctactccggcgtgtccctcaaggtggtgaactccaccacggggacgggcgagcacctgaggaacgcgctgtggcacacggggaacacgccggggcaggtgcgaaccttatggcacgaccccaggaacattggctggaaggactacacggcctataggtggcacctgactcacaggcccaagactggctacatcagagtcttagtgcatgaaggaaaacaggtcatggcagactcaggacctatctatgaccaaacctacgctggcgggcggctgggtctatttgtcttctctcaagaaatggtctatttctcagacctcaagtacgaatgcagagatatttaaacaagatttgctgcatttccggcaatgccctgtgcatgccatggtccctagacacctcagttcattgtggtccttgtggcttctctctctagcagcacctcctgtcccttgaccttaactctgatggttcttcacctcctgccagcaaccccaaacccaagtgccttcagaggataaatatcaatggaactcagagatgaacatctaacccactagaggaaaccagtttggtgatatatgagactttatgtggagtgaaaattgggcatgccattacattgctttttcttgtttgtttaaaaagaatgacgtttacatataaaatgtaattacttattgtatttatgtgtatatggagttgaagggaatactgtgcataagccattatgataaattaagcatgaaaaatattgctgaactacttttggtgcttaaagttgtcactattcttgaattagagttgctctacaatgacacacaaatcccattaaataaattataaacaagggtcaattcaaatttgaagtaatgttttagtaaggagagattagaagacaacaggcatagcaaatgacataagctaccgattaactaatcggaacatgtaaaacagttacaaaaataaacgaactctcctcttgtcctacaatgaaagccctcatgtgcagtagagatgcagtttcatcaaagaacaaacatccttgcaaatgggtgtgacgcggttccagatgtggatttggcaaaacctcatttaagtaaaaggttagcagagcaaagtgcggtgctttagctgctgcttgtgccgctgtggcgtcggggaggctcctgcctgagcttccttccccagctttgctgcctgagaggaaccagagcagacgcacaggccggaaaaggcgcatctaacgcgtatctaggctttggtaactgcggacaagttgcttttacctgatttgatgatacatttcattaaggttccagttataaatattttgttaatatttattaagtgactatagaatgcaactccatttaccagtaacttattttaaatatgcctagtaacacatatgtagtataatttctagaaacaaacatctaataagtatataatcctgtgaaaatatgaggcttgataatattaggttgtcacgatgaagcatgctagaagctgtaacagaatacatagagaataatgaggagtttatgatggaaccttaaatatataatgttgccagcgattttagttcaatatttgttactgttatctatctgctgtatatggaattcttttaattcaaacgctgaaaagaatcagcatttagtcttgccaggcacacccaataatcagtcatgtgtaatatgcacaagtttgtttttgtttttgttttttttgttggttggtttgtttttttgctttaagttgcatgatctttctgcaggaaatagtcactcatcccactccacataaggggtttagtaagagaagtctgtctgtctgatgatggatagggggcaaatctttttcccctttctgttaatagtcatcacatttctatgccaaacaggaacaatccataactttagtcttaatgtacacattgcattttgataaaattaattttgttgtttcctttgaggttgatcgttgtgttgttgttttgctgcactttttacttttttgcgtgtggagctgtattcccgagaccaacgaagcgttgggatacttcattaaatgtagcgactgtcaacagcgtgcaggttttctgtttctgtgttgtggggtcaaccgtacaatggtgtgggagtgacgatgatgtgaatatttagaatgtaccatattttttgtaaattatttatgtttttctaaacaaatttatcgtataggttgatgaaacgtcatgtgttttgccaaagactgtaaatatttatttatgtgttcacatggtcaaaatttcaccactgaaaccctgcacttagctagaacctcatttttaaagattaacaacaggaaataaattgtaaaaaaggttttctatacatgaaaaaaaaaaaaaaaaaa

SEQ ID NO: 88 - DNA, 5546 bp, Homo sapiens; identical to SEQ ID NO: 68

SEQ ID NO: 89 - DNA, 4468 bp, Homo sapiens
gatttcctgagcatgcctagggaatgacaggcatctccacaggcaggctgcatccaccttggctggggtgtcgtcattggctgcctattagaaaaacgacaggacaatgcataccaccgcctcccgactgtaaacataggggatatgtgttcacttagcatggacttctgggaggggccaaggaagggcggtctggagttttattgaatagagcagtgtgtattcggctgcctgcctgcccgcctgcttgctctctggctgtgctcctgcttaaagaaatcagtccttcctttccgacttagtcctcgggaagaagtttcagactacaaggtatcattggaacatttcaagatcatcaaatcaaattccacagggattggtgaccaaccagaaggctcagacatctgattgctgacctgtccagacatcatctggtctccctgaacctgaaatcacaccatggatgattttgagcgtcgcagagaacttagaaggcaaaagagggaggagatgcgactcgaagcagaaagaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgcaaaatgacacagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcattggagaaaatcagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatatttcatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccacgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaatgtctttttctcacttatttttatgtacaatattgatagtgagaggtatgtctattataataaagattatggcacagtaaaaaaaaaaaaaaaaaa

SEQ ID NO: 90 - DNA, 891 bp, Homo sapiens
accccatcccccactcctataccggtcctccattttggtgcctgcaaagctctgggaaagaatcccgggaaacgaaaaatggtgggtttgggggaagggaggtaaggggagaaagctggagggaggggctttaattggaggccccgtagaggacgcgcggaacttctaaggtgggaaaaaacgaaattaaaaaatcctttgatatcagggctctgaatcctgctggtcagagcaccaagcattcagtctctctccttgcctttgtcttacttgtgttcaaagaaaaacaaccagaaaaaaaaaatctcatcatggcaaatattcaccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagc

SEQ ID NO: 91 - DNA, 2750 bp, Homo sapiens
attgtttcctactccattttctctggggcaatagcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacagttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagataaagaaaaaaacaaacccgagaaacaatgaccccaagagcatgaagctaccccaggaacagcgtcagcttccatatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtgaaaggaaaaaaaaaaaaaaaaaa

SEQ ID NO: 92 - DNA, 3969 bp, Homo sapiens
ggcccagaaatagcagcggcgcgttcccctcggcgcagagcgacgggcagaggcgagagacgccgcggggccgggcggcggccccggaaggatgctgctgagccccggcactgcctggctgcgagcacatgatggcgatacgggagctcaaagtgtgccttctcggggacactggggttgggaaatcaagcatcgtgtgtcgatttgtccaggatcactttgaccacaacatcagccctactattggggcatcttttatgaccaaaactgtgccttgtggaaatgaacttcacaagttcctcatctgggacactgctggtcaggaacggtttcattcattggctcccatgtactatcgaggctcagctgcagctgttatcgtgtatgatattaccaagcaggattcattttataccttgaagaaatgggtcaaggagctgaaagaacatggtccagaaaacattgtaatggccatcgctggaaacaagtgcgacctctcagatattagggaggttcccctgaaggatgctaaggaatacgctgaatccataggtgccatcgtggttgagacaagtgcaaaaaatgctattaatatcgaagagctctttcaaggaatcagccgccagatcccacccttggacccccatgaaaatggaaacaatggaacaatcaaagttgagaagccaaccatgcaagccagccgccggtgctgttgacccaagggccgtggtccacggtacttgaagaagccagagcccacatcctgtgcactgctgaaggaccctacgctcggtggcctggcacctcactttgagaagagtgagcacactggctttgcatcctggaagacctgcagggggcggggcaggaaatgtacctgaaaaggattttagaaaaccctgggaaaacccaccacaccaccacaaaatggcctttagtgtatgaaatgcacatggaggggatgtagttgcatttttgctaaaaaaaaaaaaaaacctttaaaaattgttggatgtgtacaaaagtcttactgccttattatgtgtatgggattctaaagtggcattccacttggatttcctgtgctacctatcccaaattcccagtaactacttcagtgtcattgcctttgttacctaaccaaccttcactgaaaggcaaatttagttcaggaggttagtttttagctagctttggaagtaagcctttatttattactttttggaggaaatcagagaagtgtcaatggaccgtcactcagactgagacttgagttattacagaagccaggaaaagtgtattagaaactgttgtctacaccacttttaattggtgaacaatttttctaagttatggtcatatatacccaaacaaaccaaatcaaactaaattactgcatataattttgggattgggtggcctagtttgaaagagtgatttaagtaatcactatgtaagtggtgagagatgcaggacatacacattattcaagagaccacctgacatgcatctcctccgcaggaatacattcgtcctctcttagagaagtttaacgcacatagtattattttactaagagaatatctcttggtgtcatatctaggggaagagaattaactagaattaaatttaatgtttgaatctaaatcattgggcaaacttctaataataacaattaataataggttacaggaaagccagccagaggaagtgtcagcactttaaaattctagaccccaaaaaactacaaaatcagaaaaagtatttttatgtttctagcttgaggagaagggctttagggctaaccagaggtctgaccctagaatgccaaggaactgagaatgggctccgatgaaaaccttccttttcagattccctgtctgctcaattaaagatgtttgaatccaaaggaagtcaaggaagaaaaagcatggaaaggaagagaactgattcctactgaaaattcaaattctattaccattctaactttcataaaaagttgggatcaagaagcagctgatttcctgccagggcttatattagggggtgattcttaaaggacattaggattggtgctcagaaatggttaatcatgctgtgtgctagccagggccagctggtaccttctttgccatgagcattcaagggacagctaacctttattgacaatctatattgcaaaagtcaggaaagaggttgtgagctgattggattaaagacctggcacttcagtaactcagcacgcttccacttcactcaacttaagagagttcattgacagtgttaggatgtgaaggctgggaaacacttattttgcttcaagagttccacttggctctcccaaataggtacctcaaaaactgttagcaagcggcatttggatgtcttgacaggggctttgcagggatttttagggttttttccacattgtccacattaatggttggcatgattgtgcttgcaggccaagaaatgatcataccccttgccaaaggtaaaaaaaaaaaaaaaaaaatgagttgaaaattgaagtgacctctttccagctgacttgcaggcttattttgtaacctttcctcatccagttttccctgagaacctgggtttatctctagatagctgttcaggttttttagctgaggggtaagtatcctagctgagagttttgcatctttgggctgggtttgcagtggttgtgttttgcataaaatgtctagtctttgccacagatagtgagctacccactaatgagcccatggttttatttcagaagcacatgagggtgtgaaaccactctgttacctttctgtattgtcttagctattcaagccagtcagaggataatatatatattctcatcagcactcagagtagtcagtgaagagagtaggatcacacttggggcacaccaggattcacataaacattgtatcttctctgtggatgctcaggccttgtctacaatgaggctttacaaccttccttgtttggctcgggattacttcctggctgtctaataattgaaccataaccatgtaatattatgtaaaggcctggaaattactgttgctaaaaaaagtcatgtagtttcatgtagtgtagcatccttggcatcgttttccaaaatttgttccttctcccttttttttttctttcgtgtgtggcatgagtgtgtatctgtgtaaatatgattgtatatgtgttactccgatatgtaatccatttcactggctgagtttggcccctagccatgtgttaatataaagtagggcatgggcttcccaatggaaatctctgagaatgacagtggagttgtgcaagcattttacattgccacataattgacttgccattttatggttaaaaacgggcacattaggcagttgaatatgacgttaccttgcagactaaaaggttgaaggcccgaaactaacttttagctaacaataagggctgtgccccaatggaaactgagttcattttctgagaaaggtttggatgactgaaatatttcctctacagtcaaggactttggcatgcggtggctgaaactgagcttttttgtgtgggctccagttctcactgttctgcaatgctcatggcaagttgaatggtgagctagcttataaattaaagagctctgaactgtattcagaccgactgggtatctagcttactgttttaacatcattgttgaaaccagaccctgtagtccagtggtgctgccctgttgtgcaaactgctcctttttctcgtgtttttgtaaagagcttccatctgggctggacccagttcttgcacatacaagacaccgctgcagtcagctaggacctttccgccatgtattctattctgtagtaaagcatttccatcaacaatgcctaattgtatctgttatttttggtttaacacacactgattcatactaataaatattttcagttttaaaaaaaaaaaaaaaaaaaaaaa

SEQ ID NO: 93 - DNA, 8439 bp, Homo sapiens
cgcactctccgtccccgcggctggcgcaggacctcactcgagcggagcgcccacggggagcgggtcgcggggcggcggcggcgaggaggaggcgagaaggagttggaggaggaggaggaggaggcgagggcgagctagcccagcggggtcccggccgccccgcgggccaaagtcgagccctcccgcccgtgggcgagcgcgccagccgccccttccagaacagccgccgccacaaagaagaacggggggtgccgaggtccccatgacctcctaaagtggtgcggtccctgctgagtgcgctgcccgggccgtgacccgcgcccctgtgcgtccccgcgcgcctccgagcgcccctgtgcgccccggcccgcgccccgccggcatggacgtccatacccgctggaaagcgcgcagcgcgctccgcccgggcgccccgctgctgcccccgctgctgctgctgctgctgtgggcgccgcctccgagccgcgcagctcagccagcagatctcctgaaggttctagattttcacaacttgcctgatggaataacaaagacaacaggcttttgcgccacgcggcgatcttccaaaggcccggatgtcgcttacagagtcaccaaagacgcgcagctcagcgcacccaccaagcagctgtaccctgcgtctgcatttcccgaggacttctccatcctaacaactgtgaaagccaagaaaggcagccaggccttcctggtctccatctacaacgagcagggtatccagcagattgggctggagctgggccgctctcccgtcttcctctacgaggaccacacggggaagcctggcccggaagactaccccctcttccggggcatcaacctgtcagatggcaagtggcacagaattgctctcagcgtccacaagaaaaatgtcaccttgatcctcgactgtaaaaagaagaccaccaaattcctcgaccgcagcgaccaccccatgatcgacatcaatggcatcatcgtgtttggcacccggatcctggatgaggaggtgtttgagggtgacatccagcagctgctctttgtctcggaccaccgggcagcttatgattactgtgagcactacagccctgactgtgacaccgcagtacctgacaccccacagtcgcaggaccccaatccagatgaatattacacggaaggagacggcgagggtgagacctattactacgaatacccctactacgaagaccccgaagacctagggaaggagcccacccccagcaagaagcccgtggaagctgccaaagaaaccacagaggtccccgaggagctgaccccgacccccacggaagctgctcccatgcctgaaaccagtgaaggggctgggaaggaagaggacgtcggcatcggggactatgactacgtgcccagtgaggactactacacgccctcaccgtatgatgacctcacctatggcgagggggaggagaaccccgaccagcccacagacccaggcgctggggccgaaattcccaccagcaccgccgacacctccaactcctccaatccagctccgcctccaggggaaggtgcggatgacttggagggggagttcactgaggaaacgatccggaaccttgacgagaactactacgacccctactacgaccccaccagctccccgtcggagatcgggccgggaatgccggcgaaccaggataccatctatgaagggattggaggacctcggggcgagaaaggccaaaagggagaaccagcgattatcgagccgggcatgctcatcgagggcccgcctggcccagaaggccccgcgggtcttcccggacctccaggaaccatgggtcccactggccaagtcggggaccctggagaaaggggcccccctggacgcccaggccttcctggggccgatggcctgcccggtcctccaggaaccatgctcatgctgcccttccggtttggaggtggcggcgatgcgggctccaaaggccccatggtctcagcccaggagtcccaggcgcaagccattctccagcaggccaggttggcactgaggggaccagctggcccgatgggtctcacagggagacctggccctgtgggtccccctgggagcggaggtttgaagggcgagccgggagacgtggggcctcagggtcctcgaggtgtgcaaggcccgcctggtccggccgggaagcccggaagacggggtcgggctgggagtgatggagccagaggaatgcctggacaaactggccccaagggtgaccggggtttcgacggcctggctgggttgccaggcgagaagggccacaggggtgaccctggtccttccggcccaccaggacctccgggagacgatggagaaaggggtgacgacggagaagttgggcccagggggctgcctggggagcccgggccacgtggtctgcttgggccgaaggggcccccaggtcctcccggacctcccggtgtcacgggtatggacggccagccggggccaaaaggaaatgtgggtccccagggagagcctggccccccaggacagcagggtaatccaggcgcccagggtcttccaggcccccagggtgcaattggtcctccaggagaaaagggtcccttggggaaaccaggccttccaggaatgcccggtgctgacggacccccgggacaccctggcaaagaaggccctccaggagagaaaggaggtcagggtccacctggcccccagggtccgattggctacccaggtcctcgaggagtcaagggggccgatggcatccgtggtctgaagggcacaaagggcgagaagggtgaagacggctttcctgggtttaaaggagacatgggcatcaagggtgatcggggggagatcggcccacccggtcccaggggagaagatggccctgaaggcccaaagggtcgcggaggtcccaatggtgaccccggtcctctgggaccccctggggagaagggaaaactcggagtcccagggttaccagggtatccaggaagacaaggaccaaagggctctattggattccctggatttcctggcgccaatggagagaagggcggcagggggacccctggaaagccaggaccgcgggggcagcgaggcccaacgggtccgaggggtgaaagaggcccccggggcatcactgggaagcctggccccaagggcaactccggaggtgacggcccagctggccctcctggtgaacggggacccaatggaccccaaggacccacaggatttcctggaccaaagggcccccctggccctccaggcaaggatggactcccaggacaccctggacagagaggcgagactggtttccaaggcaagaccggccctccaggcccccccggcgtggtcggccctcagggtcccacgggagaaacgggcccaatgggtgagcgtggccaccctgggccccctggaccccccggtgaacaggggcttccgggccttgctggaaaagaagggacgaagggtgacccaggccctgcaggcctccctgggaaagatggccctccaggattacgtggtttccctggggaccgagggcttcctggtccagtgggagctcttggactgaaaggcaatgaagggccccctggcccaccaggccctgcgggatctccaggggagagaggtccagctggagccgctgggcccatcggaattccagggagacctgggccccagggacccccagggccggcaggagagaaaggggctcctggcgagaaaggcccacaaggcccagctggccgagacggtctccaggggcctgtggggctcccgggtccagctggccctgtgggtccccctggagaagacggagataagggagagatcggggagccggggcagaaaggaagcaagggggacaaaggagaacagggtcctcctgggcctacaggtcctcaaggccccatcggacagccaggcccctctggagctgacggcgagccggggcctcggggccagcagggccttttcgggcagaaaggtgatgaaggtcccagaggctttcctggaccccctgggccagtggggctgcagggtttgccaggacctccaggcgagaagggtgagacaggagacgtgggccagatgggccccccgggtccccctggcccccgaggaccctccggagctccaggtgctgatggcccacaaggtcccccaggtggaataggaaaccctggtgcagtgggagagaagggcgagcctggcgaagcaggtgagcctggccttccgggagaaggcggccccccgggacccaaaggagaaaggggagagaagggcgagtcaggcccttcaggtgctgccggaccccctggacccaaaggccctcccggagatgatggtcccaaaggcagccctggcccagtgggttttcctggagatcctggcccccccggagagcctggccccgcgggtcaagatggtccccctggtgacaaaggagatgatggtgaacccgggcagacgggatcccccggccctactggtgaaccaggtccatcggggcctccaggaaaaaggggtcccccaggccccgcaggccccgaaggcagacagggagagaaaggggccaagggagaagccggcttggaaggccctcctgggaagactggccccatcggcccccagggggcccctgggaagcccggaccggatggccttcgagggatccctggccctgtgggagaacaaggtctcccaggatccccaggcccggacggtccccccggccccatgggtcccccaggacttcccggcctcaaaggagattctggtcccaaaggtgaaaagggtcatccaggcctgatcgggctcatcggtcctccgggtgaacagggtgagaagggcgaccgtggtctccctggcccccagggctcctccggtcctaagggagaacagggtatcactggtccttctggcccgattgggcctcctgggccccctggcctgccgggtccgcctggtccaaaaggtgctaagggctcctcgggtccaactggcccgaagggtgaggcaggccacccaggacccccaggccccccgggccccccgggagaggtcatccagcccctgccaatccaggcatccaggacgcggcggaacatcgacgccagccagctgctggacgacgggaatggcgagaactacgtggactacgcggacggcatggaagagatcttcggctctctcaactctctgaagctggagattgagcagatgaaacggcccctgggcacgcagcagaaccccgcccgcacctgcaaggacctgcagctctgccaccccgacttcccagatggtgaatactgggtcgatcctaaccaaggatgctccagggattccttcaaggtttactgcaacttcacagccggggggtcgacatgcgtcttccctgacaagaagtccgaaggggccagaatcacttcttggcccaaagaaaacccgggctcctggttcagtgaattcaagcgtgggaaactgctctcctatgtggacgccgagggcaaccctgtgggtgtggtacagatgaccttcctgcggctgctgagcgcctctgcccaccagaacgtcacctaccactgctaccagtcagtggcctggcaggacgcagccacgggcagctacgacaaggccctccgcttcctgggctccaacgacgaggagatgtcctatgacaacaacccctacatccgcgccctggtggacggctgtgctaccaagaaaggctaccagaagacggttctggagatcgacacccccaaagtggagcaggtgcccatcgtggacatcatgttcaatgacttcggtgaagcgtcacagaaatttggatttgaagtggggccggcttgcttcatgggctaggagccgccgagcccgggctcccgagagcaacctcgtgacctcagcatgccattcgttcgtgagtgtcccgtgcacgtcctgaccctggacagtgaaggcttctccctcccctcccacctgacttcatctacgcctcggcaccacggggtgtgggaccccagcccggagagaacagagggaaggagccgcgcccccacctggagctgaatcacatgacctagctgcaccccagcgcctgggcccgccccacgctctgtccacacccacgcgccccgggagcggggccatgcctccagccccccagctcgcccgacccatcctgttcgtgaataggtctcaggggttgggggagggactgccagatttggacactatatttttttctaaattcaacttgaagatgtgtatttcccctgaccttcaaaaaatgttccaaggtaagcctcgtaaaggtcatcccaccatcaccaaagcctccgtttttaacaacctccaacacgatccatttagaggccaaatgtcattctgcaggtgccttcccgatggattaaaggtgcttatgtttttgtgagttttaagtaaatatttgtattgtattgttataaatgttaagtgtgcctggctttcaatcatgcacggaaacccagtctcagtcccacggacagaatgggcgaggcatggattctgggttgcagtaccgttctgattagaaataggaagtctccccacccccgccctggccaagaacgtgcaataaattggaagtttgccccggggcagcaagaatttatgctgccattgaaaagcaggtaccagtgccccttttcagacagtttttgattcgctctagactttttttttttttaatagggaaaaaatttgataattttcttttttctacatgcacttaagactaaaacacaggtttggattaattttatttgcttcctttttccgcttttcttcccgcagagcctgatgggagaatgtccagggcagggaaaccacattttttgtaggtgataactcaatgaaaattggtgcttattttttacacttctctcttgtggctctcttgtggtgctatctatctgttttaaggtctccttgaaggcgcactggggaccctggccatgcctcgttctccctgctttctttatcctgttattgcctccacagtctgttgccaaggactctaagatcaatgcacgtcactttcctttccactgggcaggatagccaagcacactccctcctgcgctctcccgccccggtgcgtccactcccgagggctgttatgaggactgggttgtgcctacttgatttgaaaacacacacaagcaataaaaagcctcttcctgcattgtctgtggtgtgaccatagcagattatatttggttcctgaatgtttgtggtgctaatttctgtgtttgttccaagccgttcagtcatgccatgcgctgcctcggtagatggagtaatgtacaatgaactccatgagtctctccagggctgcctgcagcacgtcttttccaagtagcctatttggattcccatctcaaatgtcctggatgcgagcgtcagcggctccagagctcggggcgggtgaggtcccctttggggaaccctttcctggccatcgaggtcggggggctgccgtctgtgggcaggaggacccgaggggcagccaggaaaggcgatctcttcactgtgaaaagttgcccgggtgcagcgccttttccttctaccatgggaaatgcaggctgggcccttggggtgagcctgcggggctctggtgctgtccccgacccccaccaccaccagaatgcagttccagcttaggaagccacaaacaagccacccaggaggaacaaaacaccgccagcgtggattttccaaatttccctggaaagtaagtctcgctcttgccaaagaaaagtctggcttggagagtctctggagcccaggatgccagcatgtgccaatgactgtcaccttcatctcttcaaaagaaaagccatagccgaggactgtcccgcgacccccgtggactgcgtctaggtcatgtgattctgttttcatttctcatcccatccaatttgtccttttctcctgtcattttcttcctctgtggtcccttcaaagttgttataatttgtactgaacttcaaaatgtgtcccgttctccccagaccactctagccacagtatattgcaataaaattacttcttatatttgcagaaattcttttggtgtaattttattttttcctctcaatatatataattggacaaacgctggcaaaaagaaaaaaatggtaagcaaaaaacccaagataaagtttcgaggacatcaggccttttgaaatacaatgtcaaatgacacattgtacggtttcaaaaaatccgctagacatgtcataagttttaactgtaatgcccaggaaaggatatcttaaaatattctaaacttgtgtaacaaaggaataattaactgtaatagtttttcaataaatcgagttgggtgtttccaccgtaaa

SEQ ID NO: 94 - DNA, 1580 bp, Homo sapiens
catcctgccacccctagccttgctggggacgtgaaccctctccccgcgcctgggaagccttcttggcaccgggacccggagaatccccacggaagccagttccaaaagggatgaaaagggggcgtttcgggcactgggagaagcctgtattccagggcccctcccagagcaggaatctgggacccaggagtgccagcctcacccacgcagatcctggccatgagagctccgcacctccacctctccgccgcctctggcgcccgggctctggcgaagctgctgccgctgctgatggcgcaactctgggccgcagaggcggcgctgctcccccaaaacgacacgcgcttggaccccgaagcctatggctccccgtgcgcgcgcggctcgcagccctggcaggtctcgctcttcaacggcctctcgttccactgcgcgggtgtcctggtggaccagagttgggtgctgacggccgcgcactgcggaaacaagccactgtgggctcgagtaggggatgaccacctgctgcttcttcagggagagcagctccgccggaccactcgctctgttgtccatcccaagtaccaccagggctcaggccccatcctgccaaggcgaacggatgagcacgatctcatgttgctgaagctggccaggcccgtagtgctggggccccgcgtccgggccctgcagcttccctaccgctgtgctcagcccggagaccagtgccaggttgctggctggggcaccacggccgcccggagagtgaagtacaacaagggcctgacctgctccagcatcactatcctgagccctaaagagtgtgaggtcttctaccctggcgtggtcaccaacaacatgatatgtgctggactggaccggggccaggacccttgccagagtgactctggaggccccctggtctgtgacgagaccctccaaggcatcctctcgtggggtgtttacccctgtggctctgcccagcatccagctgtctacacccagatctgcaaatacatgtcctggatcaataaagtcatacgctccaactgatccagatgctacgctccagctgatccagatgttatgctcctgctgatccagatgcccagaggctccatcgtccatcctcttcctccccagtcggctgaactctccccttgtctgcactgttcaaacctctgccgccctccacacctctaaacatctcccctctcacctcattcccccacctatccccattctctgcctgtactgaagctgaaatgcaggaagtggtggcaaaggtttattccagagaagccaggaagccggtcatcacccagcctctgagagcagttactggggtcacccaacctgacttcctctgccactccctgctgtgtgactttgggcaagccaagtgccctctctgaacctcagtttcctcatctgcaaaatgggaacaatgacgtgcctacctcttagacatgttgtgaggagactatgatataacatgtgtatgtaaatcttcatggtgattgtcatgtaaggcttaacacagtgggtggtgagttctgactaaaggttacctgttgtcgtga

SEQ ID NO: 95 - DNA, 566 bp, Homo sapiens
gccagaaccggtggagcagcgacccctgagcagtgttctctgtgctgagcggcgggactgagctgttgagttagagccaacatgagtgagcgacaaggtgctggggcaaccaatggaaaagacaagacatctggtgaaaatgatggacagaagaaagttcaagaagaatttgacattgacatggatgcaccagagacagaacgtgcagcggtggccattcagtctcagttcagaaaattccagaagaagaaggctgggtctcagtcctagtgggagaaccccctcctagtccacctgaaaacaccaaattcaaccatcatctgtcaagaaattaaaagaacaacaccctagagagaagtcatccacacacaatccacacacgcatagcaaacctccaatgcatgtacagaaacctgtgatatttatacccttgtaggaaggtatagacaatggaattgtgagtagcttaatctctatgtttctctccattttcattcctcctgcaactattttccttgatgttgtaataaaatgaagttacgatgagtgaattcaaaaaaaaaaaa

SEQ ID NO: 96 - DNA, 3447 bp, Homo sapiens; identical to SEQ ID NO: 76

SEQ ID NO: 97 - DNA, 2620 bp, Homo sapiens
agatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggcgggcttgggtcccgtggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccattaaaaaaatatctttccctttgttattgaccatctctgggctttgtatcactaattattttattttattatataataattattttattataataaaatcctgaaaggggaaaataaaaaaaa

SEQ ID NO: 98 - DNA, 2762 bp, Homo sapiens
agcggggcggggcgccagcgctgccttttctcctgccgggtagtttcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagaaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagtgtaagtgaacacagaagagtgacatgtttacaaacctcaagccagccttgctcctggctggggcctgttgaagatgcttgtattttacttttccattgtaattgctatcgccatcacagctgaacttgttgagatccccgtgttactgcctatcagcattttactactttaaaaaaaaaaaaaaaagccaaaaaccaaatttgtatttaaggtatataaattttcccaaaactgataccctttgaaaaagtataaataaaatgagcaaaagttgaa

SEQ ID NO: 99 - DNA, 5128 bp, Homo sapiens
actctggagtgggagtgggagcgagcgcttctgcgactccagttgtgagagccgcaagggcatgggaattgacgccactcaccgacccccagtctcaatctcaacgctgtgaggaaacctcgactttgccaggtccccaagggcagcggggctcggcgagcgaggcacccttctccgtccccatcccaatccaagcgctcctggcactgacgacgccaagagactcgagtgggagttaaagcttccagtgagggcagcaggtgtccaggccgggcctgcgggttcctgttgacgtcttgccctaggcaaaggtcccagttccttctcggagccggctgtcccgcgccactggaaaccgcacctccccgcagcatgggcaccagcctcagcccgaacgacccttggccgctaaacccgctgtccatccagcagaccacgctcctgctactcctgtcggtgctggccactgtgcatgtgggccagcggctgctgaggcaacggaggcggcagctccggtccgcgcccccgggcccgtttgcgtggccactgatcggaaacgcggcggcggtgggccaggcggctcacctctcgttcgctcgcctggcgcggcgctacggcgacgttttccagatccgcctgggcagctgccccatagtggtgctgaatggcgagcgcgccatccaccaggccctggtgcagcagggctcggccttcgccgaccggccggccttcgcctccttccgtgtggtgtccggcggccgcagcatggctttcggccactactcggagcactggaaggtgcagcggcgcgcagcccacagcatgatgcgcaacttcttcacgcgccagccgcgcagccgccaagtcctcgagggccacgtgctgagcgaggcgcgcgagctggtggcgctgctggtgcgcggcagcgcggacggcgccttcctcgacccgaggccgctgaccgtcgtggccgtggccaacgtcatgagtgccgtgtgtttcggctgccgctacagccacgacgaccccgagttccgtgagctgctcagccacaacgaagagttcgggcgcacggtgggcgcgggcagcctggtggacgtgatgccctggctgcagtacttccccaacccggtgcgcaccgttttccgcgaattcgagcagctcaaccgcaacttcagcaacttcatcctggacaagttcttgaggcactgcgaaagccttcggcccggggccgccccccgcgacatgatggacgcctttatcctctctgcggaaaagaaggcggccggggactcgcacggtggtggcgcgcggctggatttggagaacgtaccggccactatcactgacatcttcggcgccagccaggacaccctgtccaccgcgctgcagtggctgctcctcctcttcaccaggtatcctgatgtgcagactcgagtgcaggcagaattggatcaggtcgtggggagggaccgtctgccttgtatgggtgaccagcccaacctgccctatgtcctggccttcctttatgaagccatgcgcttctccagctttgtgcctgtcactattcctcatgccaccactgccaacacctctgtcttgggctaccacattcccaaggacactgtggtttttgtcaaccagtggtctgtgaatcatgacccagtgaagtggcctaacccggagaactttgatccagctcgattcttggacaaggatggcctcatcaacaaggacctgaccagcagagtgatgattttttcagtgggcaaaaggcggtgcattggcgaagaactttctaagatgcagctttttctcttcatctccatcctggctcaccagtgcgatttcagggccaacccaaatgagcctgcgaaaatgaatttcagttatggtctaaccattaaacccaagtcatttaaagtcaatgtcactctcagagagtccatggagctccttgatagtgctgtccaaaatttacaagccaaggaaacttgccaataagaagcaagaggcaagctgaaattttagaaatattcacatcttcggagatgaggagtaaaattcagtttttttccagttcctcttttgtgctgcttctcaattagcgtttaaggtgagcataaatcaactgtccatcaggtgaggtgtgctccatacccagcggttcttcatgagtagtgggctatgcaggagcttctgggagatttttttgagtcaaagacttaaagggcccaatgaattattatatacatactgcatcttggttatttctgaaggtagcattctttggagttaaaatgcacatatagacacatacacccaaacacttacaccaaactactgaatgaagaagtattttggtaaccaggccatttttggtgggaatccaagattggtctcccatatgcagaaatagacaaaaagtatattaaacaaagtttcagagtatattgttgaagagacagagacaagtaatttcagtgtaaagtgtgtgattgaaggtgataagggaaaagataaagaccagaaattcccttttcaccttttcaggaaaataacttagactctagtatttatgggtggatttatccttttgccttctggtatacttccttacttttaaggataaatcataaagtcagttgctcaaaaagaaatcaatagttgaattagtgagtatagtggggttccatgagttatcatgaattttaaagtatgcattattaaattgtaaaactccaaggtgatgttgtacctcttttgcttgccaaagtacagaatttgaattatcagcaaagaaaaaaaaaaaagccagccaagctttaaattatgtgaccataatgtactgatttcagtaagtctcataggttaaaaaaaaaagtcaccaaatagtgtgaaatatattacttaactgtccgtaagcagtatattagtattatcttgttcaggaaaaggttgaataatatatgccttgtgtaatattgaaaattgaaaagtacaactaacgcaaccaagtgtgctaaaaatgagcttgattaaatcaaccacctatttttgacatggaaatgaagcagggtttcttttcttcactcaaattttggcgaatctcaaaattagatcctaagatgtgttcttatttttataacatctttattgaaattctatttataatacagaatcttgttttgaaaataacctaattaatatattaaaattccaaattcatggcatgcttaaattttaactaaattttaaagccattctgattattgagttccagttgaagttagtggaaatctgaacattctcctgtggaaggcagagaaatctaagctgtgtctgcccaatgaataatggaaaatgccatgaattacctggatgttctttttacgaggtgacaagagttggggacagaactcccattacaactgaccaagtttctcttctagatgattttttgaaagttaacattaatgcctgctttttggaaagtcagaatcagaagatagtcttggaagctgtttggaaaagacagtggagatgaggtcagttgtgttttttaagatggcaattactttggtagctgggaaagcataaagctcaaatgaaatgtatgcattcacatttagaaaagtgaattgaagtttcaagttttaaagttcattgcaattaaacttccaaagaaagttctacagtgtcctaagtgctaagtgcttattacattttattaagctttttggaatctttgtaccaaaattttaaaaaagggagtttttgatagttgtgtgtatgtgtgtgtggggtggggggatggtaagagaaaagagagaaacactgaaaagaaggaaagatggttaaacattttcccactcattctgaattaattaatttggagcacaaaattcaaagcatggacatttagaagaaagatgtttggcgtagcagagttaaatctcaaataggctattaaaaaagtctacaacatagcagatctgttttgtggtttggaatattaaaaaacttcatgtaattttattttaaaatttcatagctgtacttcttgaatataaaaaatcatgccagtatttttaaaggcattagagtcaactacacaaagcaggcttgcccagtacatttaaattttttggcacttgccattccaaaatattatgccccaccaaggctgagacagtgaatttgggctgctgtagcctatttttttagattgagaaatgtgtagctgcaaaaataatcatgaaccaatctggatgcctcattatgtcaaccaggtccagatgtgctataatctgtttttacgtatgtaggcccagtcgtcatcagatgcttgcggcaaaagaaagctgtgtttatatggaagaaagtaaggtgcttggagtttacctggcttatttaatatgcttataacctagttaaagaaaggaaaagaaaacaaaaaacgaatgaaaataactgaatttggaggctggagtaatcagattactgctttaatcagaaaccctcattgtgtttctaccggagagagaatgtatttgctgacaaccattaaagtcagaagttttactccaggttattgcaataaagtataatgtttattaaatgcttcatttgtatgtcaaagctttgactctataagcaaattgcttttttccaaaacaaaaagatgtctcaggtttgttttgtgaattttctaaaagctttcatgtcccagaacttagcctttacctgtgaagtgttactacagccttaatattttcctagtagatctatattagatcaaatagttgcatagcagtatatgttaatttgtgtgtttttagctgtgacacaactgtgtgattaaaaggtatactttagtagacatttataactcaaggataccttcttatttaatcttttcttatttttgtactttatcatgaatgcttttagtgtgtgcataatagctacagtgcatagttgtagacaaagtacattctggggaaacaacatttatatgtagcctttactgtttgatataccaaattaaaaaaaaattgtatctcattacttatactgggacaccattaccaaaataataaaaatcactttcataatcttgaaaaaa

SEQ ID NO: 100 - DNA, 5927 bp, Homo sapiens
tcgtcggagcagacgggagtttctcctcggggtcggagcaggaggcacgcggagtgtgaggccacgcatgagcggacgctaaccccctccccagccacaaagagtctacatgtctagggtctagacatgttcagctttgtggacctccggctcctgctcctcttagcggccaccgccctcctgacgcacggccaagaggaaggccaagtcgagggccaagacgaagacatcccaccaatcacctgcgtacagaacggcctcaggtaccatgaccgagacgtgtggaaacccgagccctgccggatctgcgtctgcgacaacggcaaggtgttgtgcgatgacgtgatctgtgacgagaccaagaactgccccggcgccgaagtccccgagggcgagtgctgtcccgtctgccccgacggctcagagtcacccaccgaccaagaaaccaccggcgtcgagggacccaagggagacactggcccccgaggcccaaggggacccgcaggcccccctggccgagatggcatccctggacagcctggacttcccggaccccccggaccccccggacctcccggaccccctggcctcggaggaaactttgctccccagctgtcttatggctatgatgagaaatcaaccggaggaatttccgtgcctggccccatgggtccctctggtcctcgtggtctccctggcccccctggtgcacctggtccccaaggcttccaaggtccccctggtgagcctggcgagcctggagcttcaggtcccatgggtccccgaggtcccccaggtccccctggaaagaatggagatgatggggaagctggaaaacctggtcgtcctggtgagcgtgggcctcctgggcctcagggtgctcgaggattgcccggaacagctggcctccctggaatgaagggacacagaggtttcagtggtttggatggtgccaagggagatgctggtcctgctggtcctaagggtgagcctggcagccctggtgaaaatggagctcctggtcagatgggcccccgtggcctgcctggtgagagaggtcgccctggagcccctggccctgctggtgctcgtggaaatgatggtgctactggtgctgccgggccccctggtcccaccggccccgctggtcctcctggcttccctggtgctgttggtgctaagggtgaagctggtccccaagggccccgaggctctgaaggtccccagggtgtgcgtggtgagcctggcccccctggccctgctggtgctgctggccctgctggaaaccctggtgctgatggacagcctggtgctaaaggtgccaatggtgctcctggtattgctggtgctcctggcttccctggtgcccgaggcccctctggaccccagggccccggcggccctcctggtcccaagggtaacagcggtgaacctggtgctcctggcagcaaaggagacactggtgctaagggagagcctggccctgttggtgttcaaggaccccctggccctgctggagaggaaggaaagcgaggagctcgaggtgaacccggacccactggcctgcccggaccccctggcgagcgtggtggacctggtagccgtggtttccctggcgcagatggtgttgctggtcccaagggtcccgctggtgaacgtggttctcctggccctgctggccccaaaggatctcctggtgaagctggtcgtcccggtgaagctggtctgcctggtgccaagggtctgactggaagccctggcagccctggtcctgatggcaaaactggcccccctggtcccgccggtcaagatggtcgccccggacccccaggcccacctggtgcccgtggtcaggctggtgtgatgggattccctggacctaaaggtgctgctggagagcccggcaaggctggagagcgaggtgttcccggaccccctggcgctgtcggtcctgctggcaaagatggagaggctggagctcagggaccccctggccctgctggtcccgctggcgagagaggtgaacaaggccctgctggctcccccggattccagggtctccctggtcctgctggtcctccaggtgaagcaggcaaacctggtgaacagggtgttcctggagaccttggcgcccctggcccctctggagcaagaggcgagagaggtttccctggcgagcgtggtgtgcaaggtccccctggtcctgctggtccccgaggggccaacggtgctcccggcaacgatggtgctaagggtgatgctggtgcccctggagctcccggtagccagggcgcccctggccttcagggaatgcctggtgaacgtggtgcagctggtcttccagggcctaagggtgacagaggtgatgctggtcccaaaggtgctgatggctctcctggcaaagatggcgtccgtggtctgactggccccattggtcctcctggccctgctggtgcccctggtgacaagggtgaaagtggtcccagcggccctgctggtcccactggagctcgtggtgcccccggagaccgtggtgagcctggtccccccggccctgctggctttgctggcccccctggtgctgacggccaacctggtgctaaaggcgaacctggtgatgctggtgctaaaggcgatgctggtccccctggccctgccggacccgctggaccccctggccccattggtaatgttggtgctcctggagccaaaggtgctcgcggcagcgctggtccccctggtgctactggtttccctggtgctgctggccgagtcggtcctcctggcccctctggaaatgctggaccccctggccctcctggtcctgctggcaaagaaggcggcaaaggtccccgtggtgagactggccctgctggacgtcctggtgaagttggtccccctggtccccctggccctgctggcgagaaaggatcccctggtgctgatggtcctgctggtgctcctggtactcccgggcctcaaggtattgctggacagcgtggtgtggtcggcctgcctggtcagagaggagagagaggcttccctggtcttcctggcccctctggtgaacctggcaaacaaggtccctctggagcaagtggtgaacgtggtccccctggtcccatgggcccccctggattggctggaccccctggtgaatctggacgtgagggggctcctggtgccgaaggttcccctggacgagacggttctcctggcgccaagggtgaccgtggtgagaccggccccgctggaccccctggtgctcctggtgctcctggtgcccctggccccgttggccctgctggcaagagtggtgatcgtggtgagactggtcctgctggtcccgccggtcctgtcggccctgttggcgcccgtggccccgccggaccccaaggcccccgtggtgacaagggtgagacaggcgaacagggcgacagaggcataaagggtcaccgtggcttctctggcctccagggtccccctggccctcctggctctcctggtgaacaaggtccctctggagcctctggtcctgctggtccccgaggtccccctggctctgctggtgctcctggcaaagatggactcaacggtctccctggccccattgggccccctggtcctcgcggtcgcactggtgatgctggtcctgttggtccccccggccctcctggacctcctggtccccctggtcctcccagcgctggtttcgacttcagcttcctgccccagccacctcaagagaaggctcacgatggtggccgctactaccgggctgatgatgccaatgtggttcgtgaccgtgacctcgaggtggacaccaccctcaagagcctgagccagcagatcgagaacatccggagcccagagggcagccgcaagaaccccgcccgcacctgccgtgacctcaagatgtgccactctgactggaagagtggagagtactggattgaccccaaccaaggctgcaacctggatgccatcaaagtcttctgcaacatggagactggtgagacctgcgtgtaccccactcagcccagtgtggcccagaagaactggtacatcagcaagaaccccaaggacaagaggcatgtctggttcggcgagagcatgaccgatggattccagttcgagtatggcggccagggctccgaccctgccgatgtggccatccagctgaccttcctgcgcctgatgtccaccgaggcctcccagaacatcacctaccactgcaagaacagcgtggcctacatggaccagcagactggcaacctcaagaaggccctgctcctccagggctccaacgagatcgagatccgcgccgagggcaacagccgcttcacctacagcgtcactgtcgatggctgcacgagtcacaccggagcctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaagtgcattcaaccttaccaaaaaaaaaaaaaaaaaaagaataaataaataactttttaaaaaaggaagcttggtccacttgcttgaagacccatgcgggggtaagtccctttctgcccgttgggcttatgaaaccccaatgctgccctttctgctcctttctccacaccccccttggggcctcccctccactccttcccaaatctgtctccccagaagacacaggaaacaatgtattgtctgcccagcaatcaaaggcaatgctcaaacacccaagtggcccccaccctcagcccgctcctgcccgcccagcacccccaggccctgggggacctggggttctcagactgccaaagaagccttgccatctggcgctcccatggctcttgcaacatctccccttcgtttttgagggggtcatgccgggggagccaccagcccctcactgggttcggaggagagtcaggaagggccacgacaaagcagaaacatcggatttggggaacgcgtgtcaatcccttgtgccgcagggctgggcgggagagactgttctgttccttgtgtaactgtgttgctgaaagactacctcgttcttgtcttgatgtgtcaccggggcaactgcctgggggcggggatgggggcagggtggaagcggctccccattttataccaaaggtgctacatctatgtgatgggtggggtggggagggaatcactggtgctatagaaattgagatgcccccccaggccagcaaatgttcctttttgttcaaagtctatttttattccttgatatttttctttttttttttttttttttgtggatggggacttgtgaatttttctaaaggtgctatttaacatgggaggagagcgtgtgcggctccagcccagcccgctgctcactttccaccctctctccacctgcctctggcttctcaggcctctgctctccgacctctctcctctgaaaccctcctccacagctgcagcccatcctcccggctccctcctagtctgtcctgcgtcctctgtccccgggtttcagagacaacttcccaaagcacaaagcagtttttccccctaggggtgggaggaagcaaaagactctgtacctattttgtatgtgtataataatttgagatgtttttaattattttgattgctggaataaagcatgtggaaatgacccaaacataa

SEQ ID NO: 101 - DNA, 4608 bp, Homo sapiens
gacagaagtgaatgggaatggagaggccggcggcccgggagccgcatgggcccgacgcgctgcggcgcttccagggactgctgctggaccgccgaggccggctgcaccgccaggtgctgcgcctgcgcgaggtggcccggcgcctggagcgcctgcgcaggcgctccctcgtagccaacgtggccggcagctcgctgagcgcaacgggcgccctcgccgccatcgtggggctctcgctcagcccggtcaccctggggacctcgctgctggtgtcggccgtggggctgggggtggccacagccggaggggccgtcaccatcacgtccgatctctcgctgatcttctgcaactcccgggagctgcggagggtgcaggagatcgcggccacctgccaggaccagatgcgagagatcctgagctgcctcgagtttttctgccgctggcagggctgcggggaccgccagctgctgcagtgcgggaggaacgcctccatcgccctgtacaattctgtctacttcatcgtcttctttggctcacgtggcttcctcatccccaggcgggcggagggggacaccaaggttagccaggccgtgctgaaggccaagattcagaaactggccgagagcctggagtcctgcaccggggctctggacgaactcagcgagcagctggagtctcgggttcagctctgcaccaagtccagtcgtggccacgacctcaagatctctgctgaccagcgtgcagggctgtttttctgagaacatcctttccccctaatgaccgaggccagcaaatcatcctcatgggatgctccagaatttgtagctcccttaggaaaacaccaagctgggttaggagccgaaggcaaaggatgagaaaaactgtttttgaagtgggcaggtccccaaagcccttcttttcccatcactgtgacatctgcctgggcttgagtgctacggacttttcagtcttcctagtggaaaaatgtgacccaaaaactccttttcctttatcaaaaactttctgtctaaacacagctgggcaggcactcctgttttaaagttatttcggggtccctgaccctgccctggtggcttggcctgagactggagagagtgccatcctctgggtcctctccaagtcctactagtctttgaagtcctcaaaatgtgcgtgaggaaggcatttgcctctattccagaatttctgatacaaagaactccagaatccagagcaaatcagcccttctctgaacgttgtaggatggttcagaacccagagaggaccctggtgctgatatctcctcctcttccctttcccctcagcttacttactcccagatgcggcctgggtatgaagtaggcctttcctgagtggctcccaatccagtcctccaagtactcagaggggaagcccgtgaagccgtcatctaagtcctgctccctcacatgaagctgagggccagatagatggagcgactgccaacttcatttcccgacatcattgtgttcagaagagagtgatgggttttgagttagacagtcctgggcttgagacaggctttgtcactactgtgtgagtgtagccacctaatctctctgagactgtgtaaaacaaagatgataaaatctcaccctgttgtgagatattaaatgagccaaagtgcctagcatgatggtgctggctcatatagtgtagtccctggaatggcaaattaacatcacccaggaacttgttagaaaggcaaattcttggacacaaccctcctgatttatggaatcagaaactctggctgtggggcccagcaacctgagtttaaacaatttctctgggtggttctgcggcacactaaggtttgaaaatcactacaacaaatgctaacttctaatccccttgatgagctttcacgaagtctcacggcttctctagggactccatggtcttcagagtcgttcacagatgaccaaggacagactgtgtcccagaagccaaaatgagagagagagagagagcacgcgtacgtgcaccctggggcagtgtctcaccgtatgaataagggatgtaacactaaaagcccattagggggcagtgtttcccgcctgttgtagaaactggtacagaaaggatcctatatgaagttcctgaaactgacctttgtctattattaccttctctgaaaagtgccagtccatgtattttttatttattttaagtttgtaatttaatttttaattattgtttagtgtttgcatttaattttatttaatcaccacatttagaaaataataagagcaagtttctaaatgggagactgctgaggctctttgcaagagatgagattaagtttgagtttctaaggcagggcatgagctggaaatagcattgctttccttgattgtctctctccttcagggagattctttttctctagtgttttaagtgatcctttgaagtaagtgtggagagtcttgaatggcaagaccaggagctgagtttaagcttgtaatggaagcttgcattgtgggatatataactgaggaagcatatttatcctgaaggtattttgccagaaggtatcacttgacctggaaaaggaatctatttagttcaggaaagataaaaagtttagaggtatgtgaaggaagcacttagaacttgcaagcctgatgtcctatcaagttatgtcttctgggtgacagacaaaatagcttgtcttatggtggtgatgtgttgcattttcactttggggtctgtaagaaactgtcagtgaaaatatgtacaattccttcaatttccattcttaacaactgtaatgttgaaaaataagttgaaaagtctttgggaccatacatgcaaaaacggtgcctctgttacttaattatttaatattctataaatgtacccaatctgtccgcacccttcccagtgatggggcagtatgtctgaggaagtataatttcagtactggggtcggggagaggaggtgatgtttctacatttttattttttctataaattgcaattggtctgtatgctggtttattttgaaatttatattggtttcttttcaagctggtgtcatctcctagactgtttcacccagatgctagcattttttttttttttgagacagagtctcactctgtcacctaggctggagttgcagtggtttgatctcggctcactgcaacctccgactcctgggttcaagcaattcttctgcctcagcctcctgagtagctgggattacagatgtgcaccagcacacccggctaattttttgtatttttagtagagacagggtttcgccatgttggccaggctggtcttgaactcctggccttatgtgatccgcccaccttggcttcccaaagtgctgggattacaggcatgagccacctcgcctggccagatgctagcattttagatcaaacaattcattttagatgaattgttttgtttcacaatcattttaaatcattttagaatgtacttcacattattagttgtgttatggcataaaggtacaaccattccctaactccatcttttattaatgcttaagtttaaattatattcttccaatgcctaagctattccctagaattaaactgggcacttttggaagcagcaacagtaacagcagcagcaaacttttcctctcatattttgggtgtatcaaaagttctagacttttgaagttatgatttcagtggcccactttatttctaaggaagagtgtctactttggaacgatactttgcacatagtaggaactcaagaaatacatttgaataattataattaactgtttagctatcttaatgagaatttgttgacaacaaaagatcatccatcgccttatgtgtgagtaagattggagcctctatcaagatttagtcaagttcagttagattgattctagaaacaaatatttatttctttcttttacggggatgtgaataaggcttttccttaaggccttcattctttaaacaaacaggttgaaatggtatgttgtaaaagagaagacgggagagaggtatttagatgataagtgtacttcacaaaaatgccaaagtttgaaaaataggtatgtttgttctaaatgtttaagtgcttctctgttaggttctggggcttgcaatcatttgaattgttctgtttcacaataaaggagattcactgggttctgcattttcaggattcaatagaactgctccattaaaaaaataatccttagcaagcattcgaatcctaactgctttgatgcacttgccctcgggcacctgtcatttccaatatggtaggtgtcaaagtcaaaagtatttactgggagaaaaaagagaggagtggttgtagaagtctccctaaatcagacatgtcaagcaatcagccaacgtggtgtatttctcattcaatattttagtgtgaattgagacactgagataaagacatcgtgcagagataaatggggatacagttaaatgtagcaactcttgagttcattttttcccactgtagcaaaattaatgctttctctttattgaaataaattgctcattcctccaaaaaaaaaaaaaaaaaaaaaaaaaaaaaaaaaaaagg

SEQ ID NO: 102 - DNA, 1677 bp, Homo sapiens
aggttctcttacatcgaccgcctaagagtcgcgctgtaagaagcaacaacctctcctcttcgtctccgccatcagctcggcagtcgcgaagcagcaaccatgcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgagacgggggctggcaagcatgtgccccgggcagtgtttgtagacttggaacccacagtcattgatgaagttcgcactggcacctaccgccagctcttccaccctgagcaacttatcacaggcaaagaagatgctgccaataactatgcccgagggcactacaccattggcaaggagatcattgacctcgtgttggaccgaattcgcaagctggccgaccagtgcacgggtctccagggcttcttggttttccacagctttggtgggggaactggttctgggttcacctcgctgctcatggaacgtctctcagttgattatggcaagaagtccaagctggagttctctatttacccggcgccccaggtttccacagctgtagttgagccctacaactccatcctcaccacccacaccaccctggagcactctgattgtgccttcatggtagacaatgaggccatctatgacatctgtcgtagaaacctcgatattgagcgtccaacctatactaacctgaataggttaataggtcaaattgtgtcctccatcactgcttccctgagatttgatggagccctgaatgttgacctgacagaattccagaccaacctggtgccctatccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaagaccaagcgtaccatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaaacgtgcctttgttcactggtacgttggggaggggatggaggaaggtgagttttcagaggcccgtgaggacatggctgcccttgagaaggattatgaggaggttggtgtggattctgttgaaggagagggtgaggaagaaggagaggaatactaaagttaaaacgtcacaaaggtgctgcttttacagggaagcttattctgttttaaacattgaaaagttgtggtctgatcagttaatttgtatgtagcagtgtatgctctcatatacaattactgacctatgctctaaaacatgaatgctttgttacagacccaagctgtccatttctgtgatgggttttgaataaagtattccctgtcttaaaaaaaaaaaaaa

SEQ ID NO: 103 - DNA, 896 bp, Homo sapiens
gaattcggcagctccaaccagggcagccttcctgagaagatgcaaccaatcctgcttctgctggccttcctcctgctgcccagggcagatgcaggggagatcatcgggggacatgaggccaagccccactcccgcccctacatggcttatcttatgatctgggatcagaagtctctgaagaggtgcggtggcttcctgatacgagacgacttcgtgctgacagctgctcactgttggggaagctccataaatgtcaccttgggggcccacaatatcaaggaacaggagccgacccagcagtttatccctgtgaaaagagccatcccccatccagcctataatcctaagaacttctccaatgacatcatgctactgcagctggagagaaaggccaagcggaccagagctgtgcagcccctcaggctacctagcaacaaggcccaggtgaagccagggcagacatgcagtgtggccggctgggggcagacggcccccctgggaaaacattcacacacactacaagaggtgaagatgacagtgcaggaagatcgaaagtgcgaatctgacttacgccattattacgacagtaccattgagttgtgcgtgggggacccagagattaaaaagacttcctttaagggggactctggaggccctcttgtgtgtaacaaggtggcccagggcattgtctcctatggacgaaacaatggcatgcctccacgagcctgcaccaaagtctcaagctttgtacactggataaagaaaaccatgaaacgctactaactacaggaagcaaactaagcccccgctgtaatgaaacaccttctctggagccaagtccagatttacactgggagaggtgccagcaactgaataaatacctcttagctgagtgg

SEQ ID NO: 104 - DNA, 6629 bp, Homo sapiens
atgaaatggaaacatgttccttttttggtcatgatatcactcctcagcttatccccaaatcacctgtttctggcccagcttattccagaccctgaagatgtagagagggggaacgaccacgggacgccaatccccacctctgataacgatgacaattcgctgggctatacaggctcccgtcttcgtcaggaagattttccacctcgcattgttgaacacccttcagacctgattgtctcaaaaggagaacctgcaactttgaactgcaaagctgaaggccgccccacacccactattgaatggtacaaagggggagagagagtggagacagacaaagatgaccctcgctcacaccgaatgttgctgccgagtggatctttatttttcttacgtatagtacatggacggaaaagtagacctgatgaaggagtctatgtctgtgtagcaaggaattaccttggagaggctgtgagccacaatgcatcgctggaagtagccatacttcgggatgacttcagacaaaacccttcggatgtcatggttgcagtaggagagcctgcagtaatggaatgccaacctccacgaggccatcctgagcccaccatttcatggaagaaagatggctctccactggatgataaagatgaaagaataactatacgaggaggaaagctcatgatcacttacacccgtaaaagtgacgctggcaaatatgtttgtgttggtaccaatatggttggggaacgtgagagtgaagtagccgagctgactgtcttagagagaccatcatttgtgaagagacccagtaacttggcagtaactgtggatgacagtgcagaatttaaatgtgaggcccgaggtgaccctgtacctacagtacgatggaggaaagatgatggagagctgcccaaatccagatatgaaatccgagatgatcataccttgaaaattaggaaggtgacagctggtgacatgggttcatacacttgtgttgcagaaaatatggtgggcaaagctgaagcatctgctactctgactgttcaagaacctccacattttgttgtgaaaccccgtgaccaggttgttgctttgggacggactgtaacttttcagtgtgaagcaaccggaaatcctcaaccagctattttctggaggagagaagggagtcagaatctacttttctcatatcaaccaccacagtcatccagccgattttcagtctcccagactggcgacctcacaattactaatgtccagcgatctgatgttggttattacatctgccagactttaaatgttgctggaagcatcatcacaaaggcatatttggaagttacagatgtgattgcagatcggcctcccccagttattcgacaaggtcctgtgaatcagactgtagccgtggatggcactttcgtcctcagctgtgtggccacaggcagtccagtgcccaccattctgtggagaaaggatggagtcctcgtttcaacccaagactctcgaatcaaacagttggagaatggagtactgcagatccgatatgctaagctgggtgatactggtcggtacacctgcattgcatcaacccccagtggtgaagcaacatggagtgcttacattgaagttcaagaatttggagttccagttcagcctccaagacctactgacccaaatttaatccctagtgccccatcaaaacctgaagtgacagatgtcagcagaaatacagtcacattatcgtggcaaccaaatttgaattcaggagcaactccaacatcttatattatagaagccttcagccatgcatctggtagcagctggcagaccgtagcagagaatgtgaaaacagaaacatctgccattaaaggactcaaacctaatgcaatttaccttttccttgtgagggcagctaatgcatatggaattagtgatccaagccaaatatcagatccagtgaaaacacaagatgtcctaccaacaagtcagggggtggaccacaagcaggtccagagagagctgggaaatgctgttctgcacctccacaaccccaccgtcctttcttcctcttccatcgaagtgcactggacagtagatcaacagtctcagtatatacaaggatataaaattctctatcggccatctggagccaaccacggagaatcagactggttagtttttgaagtgaggacgccagccaaaaacagtgtggtaatccctgatctcagaaagggagtcaactatgaaattaaggctcgccctttttttaatgaatttcaaggagcagatagtgaaatcaagtttgccaaaaccctggaagaagcacccagtgccccaccccaaggtgtaactgtatccaagaatgatggaaacggaactgcaattctagttagttggcagccacctccagaagacactcaaaatggaatggtccaagagtataaggtttggtgtctgggcaatgaaactcgataccacatcaacaaaacagtggatggttccaccttttccgtggtcattccctttcttgttcctggaatccgatacagtgtggaagtggcagccagcactggggctgggtctggggtaaagagtgagcctcagttcatccagctggatgcccatggaaaccctgtgtcacctgaggaccaagtcagcctcgctcagcagatttcagatgtggtgaagcagccggccttcatagcaggtattggagcagcctgttggatcatcctcatggtcttcagcatctggctttatcgacaccgcaagaagagaaacggacttactagtacctacgcgggtatcagaaaagtcccgtcttttaccttcacaccaacagtaacttaccagagaggaggcgaagctgtcagcagtggagggaggcctggacttctcaacatcagtgaacctgccgcgcagccatggctggcagacacgtggcctaatactggcaacaaccacaatgactgctccatcagctgctgcacggcaggcaatggaaacagcgacagcaacctcactacctacagtcgcccagctgattgtatagcaaattataacaaccaactggataacaaacaaacaaatctgatgctccctgagtcaactgtttatggtgatgtggaccttagtaacaaaatcaatgagatgaaaaccttcaatagcccaaatctgaaggatgggcgttttgtcaatccatcagggcagcctactccttacgccaccactcagctcatccagtcaaacctcagcaacaacatgaacaatggcagcggggactctggcgagaagcactggaaaccactgggacagcagaaacaagaagtggcaccagttcagtacaacatcgtggagcaaaacaagctgaacaaagattatcgagcaaatgacacagttcctccaactatcccatacaaccaatcatacgaccagaacacaggaggatcctacaacagctcagaccggggcagtagtacatctgggagtcaggggcacaagaaaggggcaagaacacccaaggtaccaaaacagggtggcatgaactgggcagacctgcttcctcctcccccagcacatcctcctccacacagcaatagcgaagagtacaacatttctgtagatgaaagctatgaccaagaaatgccatgtcccgtgccaccagcaaggatgtatttgcaacaagatgaattagaagaggaggaagatgaacgaggccccactccccctgttcggggagcagcttcttctccagctgccgtgtcctatagccatcagtccactgccactctgactccctccccacaggaagaactccagcccatgttacaggattgtccagaggagactggccacatgcagcaccagcccgacaggagacggcagcctgtgagtcctcctccaccaccacggccgatctcccctccacatacctatggctacatttcaggacccctggtctcagatatggatacggatgcgccagaagaggaagaagacgaagccgacatggaggtagccaagatgcaaaccagaaggcttttgttacgtgggcttgagcagacacctgcctccagtgttggggacctggagagctctgtcacggggtccatgatcaacggctggggctcagcctcagaggaggacaacatttccagcggacgctccagtgttagttcttcggacggctcctttttcactgatgctgactttgcccaggcagtcgcagcagcggcagagtatgctggtctgaaagtagcacgacggcaaatgcaggatgctgctggccgtcgacattttcatgcgtctcagtgccctaggcccacaagtcccgtgtctacagacagcaacatgagtgccgccgtaatgcagaaaaccagaccagccaagaaactgaaacaccagccaggacatctgcgcagagaaacctacacagatgatcttccaccacctcctgtgccgccacctgctataaagtcacctactgcccaatccaagacacagctggaagtacgacctgtagtggtgccaaaactcccttctatggatgcaagaacagacagatcatcagacagaaaaggaagcagttacaaggggagagaagtgttggatggaagacaggttgttgacatgcgaacaaatccaggtgatcccagagaagcacaggaacagcaaaatgacgggaaaggacgtggaaacaaggcagcaaaacgagaccttccaccagcaaagactcatctcatccaagaggatattctaccttattgtagacctacttttccaacatcaaataatcccagagatcccagttcctcaagctcaatgtcatcaagaggatcaggaagcagacaaagagaacaagcaaatgtaggtcgaagaaatattgcagaaatgcaggtacttggaggatatgaaagaggagaagataataatgaagaattagaggaaactgaaagctgaagacaaccaagaggcttatgagatctaatgtgaaaatcatcactcaagatgcctcctgtcagatgacacatgacgccagataaaatgttcagtgcaatcagagtgtacaaattgtcgtttttattcctcttattgggatatcattttaaaaactttattgggtttttattgttgttgtttgatccctaaccctacaaagagccttcctattcccctcgctgttggagcaaaccattataccttacttccagcaagcaaagtgctttgacttcttgcttcagtcatcagccagcaagagggaacaaaactgttcttttgcattttgccgctgagatatggcattgcactgcttatatgccaagctaatttatagcaagatattgatcaaatatagaaagttgatattcaacctcacaagggctctcaaagtataatctttctatagccaactgctaatgcaaattaaaacatatttcattttaacatgatttcaaaatcagtttttcatactaccctttgctggaagaaactaaaaatatagcaaatgcagaaccacaaacaattcgaatggggtagaaacattgtaaatatttactctttgcaaaccctggtggtattttattttggcttcatttcaatcattgaagtatattcttattggaaatgtacttttggataagtagggctaagccagttggatctctggttgtctagtcattgtcataagtaaacctagtaaaaccttgttctatttttcaatcatcaaaaagtaattataaatacgtattacaaacaagtggatgtttttaatgaccaattgagtaagaacatccctgtcttaactggcctaaatttcttctggtagtgtcagttcaactttcagaagtgccacttaaggaagtttgatttttgtttttgtaatgcactgtttttaatctctctctctttttttttttttttttggttttaaaagcacaatcactaaactttatttgtaaaccattgtaactattaaccttttttgtcttattgaaaaaaaaaatgttgagaagcgtttttaacctgttttgttaatgctctatgtttgtatttggaatatttgaataatgacagatggtgaagtaacatgcatactttattgtgggccatgaaccaaatggttcttacttttcctggacttaaagaaaaaaagaggtttaagtttgttgtggccaatgtcgaaacctacaagatttccttaaaatctctaatagaggcattacttgctttcaattgacaaatgatgccctctgactagtagatttctatgatccttttttgtcattttatgaatatcattgattttataattggtgctatttgaagaaaaaaatgtacatttattcatagatagataagtatcaggtctgaccccagtggaaaacaaagccaaacaaaactgaaccacaaaaaaaaaggctggtgttcaccaaaaccaaacttgttcatttagataatttgaaaaagttccatagaaaaggcgtgcagtactaagggaacaatccatgtgattaatgttttcattatgttcatgtaagaagccccttatttttagccataattttgcatactgaaaatccaataatcagaaaagtaattttgtcacattatttattaaaaatgttctcaaatac

SEQ ID NO: 105 - DNA, 1994 bp, Homo sapiens
gctgccaccgctcctgccactgcagtgctcgagccccgtgcaggggagcttgcgggaggatcgaccgacagacggacgcacgccgaggcactgcgcccccagccccgcgccggtgccaccgcagcccgaccccggccgccagtccagccgcccctcgcccggtgcctaggtgcccggccccacaccgccagctgctcggcgcccgggtccgccatgcgctccgccgctgtcctggctcttctgctctgcgccgggcaagtcactgcgctccctgtgaacagccctatgaataaaggggataccgaggtgatgaaatgcatcgttgaggtcatctccgacacactttccaagcccagccccatgcctgtcagccaggaatgttttgagacactccgaggagatgaacggatcctttccattctgagacatcagaatttactgaaggagctccaagacctcgctctccaaggcgccaaggagagggcacatcagcagaagaaacacagcggttttgaagatgaactctcagaggttcttgagaaccagagcagccaggccgagctgaaagaggcggtggaagagccatcatccaaggatgttatggagaaaagagaggattccaaggaggcagagaaaagtggtgaagccacagacggagccaggccccaggccctcccggagcccatgcaggagtccaaggctgaggggaacaatcaggcccctggggaggaagaggaggaggaggaggaggccaccaacacccaccctccagccagcctccccagccagaaatacccaggcccacaggccgagggggacagtgagggcctctctcagggtctggtggacagagagaagggcctgagtgcagagccagggtggcaggcaaagagagaagaggaggaggaggaggaggaggaggctgaggctggagaggaggctgtccccgaggaagaaggccccactgtagtgctgaacccccacccgagccttggctacaaggagatccggaaaggcgagagtcggtcggaggctctggctgtggatggagctgggaagcctggggctgaggaggctcaggaccccgaagggaagggagaacaggagcactcccagcagaaagaggaggaggaggagatggcagtggtcccgcaaggcctcttccggggtgggaagagcggagagctggagcaggaggaggagcggctctccaaggagtgggaggactccaaacgctggagcaagatggaccagctggccaaggagctgacggctgagaagcggctggaggggcaggaggaggaggaggacaaccgggacagttccatgaagctctccttccgggcccgggcctacggcttcaggggccctgggccgcagctgcgacgaggctggaggccatcctcccgggaggacagccttgaggcgggcctgcccctccaggtccgaggctaccccgaggagaagaaagaggaggagggcagcgcaaaccgcagaccagaggaccaggagctggagagcctgtcggccattgaagcagagctggagaaagtggcccaccagctgcaggcactacggcggggctgagacaccggctggcagggctggccccagggcaccctgtggccctggctctgctgtccccttggcaggtcctggccagatggcccggacgctgcttccggtagggaggcagcctccagcctgcccaagcccaggccaccctatcgccccctacgcgccttgtctcctactcctgactcctacctgccctggaacatcctttgcagggcagccccacaactttaaacattgacgattccttctctgaacacaggcagctttctagaagtttcccttcctccatcctatccactgggcacaactgcaataacttctgaccttttggtgaaagctgagaactcctgactgtaacatattctgtatgaactttatctaaagaaaaataaatctgttctgggctctttcctctg

SEQ ID NO: 106 - DNA, 4237 bp, Homo sapiens
tcccgaaaccagagggatggggccggctgtgcagtagaacggggatcgaaaagaggaaaacaagggcacgaagaccagcgagaaagaagaggacacctgggaaaggcggaagcagaagacggggaagggaaaagaaacccatagcaggtggaaaccagatctagagcaacaccgtcaggttcacagtttgtttttctagaagagaagaaagtacctgaggattgctcttttttcctaccgttaatgaaaactacttttgtcttcatcataaaagaaaaaactaaggggaggtaaaggcagtctcctgttttattagggggagaggtgaagggaaatccaggctcactttctgaataagccactgcctggtgcacagagcagaaccatcctggtttctgaagacacatccctttcagcagaattccagccggagtcgctggcacagttctatttttatatttaaatgtatgtctcccctggcctttttttttttttttttttttagcaacacttttcttgtttgtaaacgcgagtgaccagaaagtgtgaatgcggagtaggaatatttttcgtgttctcttttatctgcttgccttttttagagagtagcagtggttcctatttcggaaaaggacgttctaattcaaagctctctcccaatatatttacacgaatacgcatttagaaagggaggcagcttttgaggttgcaatcctactgagaaggatggaagaaggagccaggcaccgaaacaacaccgaaaagaaacacccaggtgggggcgagtcggacgccagccccgaggctggttccggagggggcggagtagccctgaagaaagagatcggattggtcagtgcctgtggtatcatcgtagggaacatcatcggctctggaatctttgtctcgccaaagggagtgctggagaatgctggttctgtgggccttgctctcatcgtctggattgtgacgggcttcatcacagttgtgggagccctctgctatgctgaactcggggtcaccatccccaaatctggaggtgactactcctatgtcaaggacatcttcggaggactggctgggttcctgaggctgtggattgctgtgctggtgatctaccccaccaaccaggctgtcatcgccctcaccttctccaactacgtgctgcagccgctcttccccacctgcttccccccagagtctggccttcggctcctggctgccatctgcttattgctcctcacatgggtcaactgttccagtgtgcggtgggccacccgggttcaagacatcttcacagctgggaagctcctggccttggccctgattatcatcatggggattgtacagatatgcaaaggagagtacttctggctggagccaaagaatgcatttgagaatttccaggaacctgacatcggcctcgtcgcactggctttccttcagggctcctttgcctatggaggctggaactttctgaattacgtgactgaggagcttgttgatccctacaagaaccttcccagagccatcttcatctccatcccactggtcacatttgtgtatgtctttgccaatgtcgcttatgtcactgcaatgtccccccaggagctgctggcatccaacgccgtcgctgtgacttttggagagaagctcctaggagtcatggcctggatcatgcccatttctgttgccctgtccacatttggaggagttaatgggtctctcttcacctcctctcggctgttcttcgctggagcccgagagggccaccttcccagtgtgttggccatgatccacgtgaagcgctgcaccccaatcccagccctgctcttcacatgcatctccaccctgctgatgctggtcaccagcgacatgtacacactcatcaactatgtgggcttcatcaactacctcttctatggggtcacggttgctggacagatagtccttcgctggaagaagcctgatatcccccgccccatcaagatcaacctgctgttccccatcatctacttgctgttctgggccttcctgctggtcttcagcctgtggtcagagccggtggtgtgtggcattggcctggccatcatgctgacaggagtgcctgtctatttcctgggtgtttactggcaacacaagcccaagtgtttcagtgacttcattgagctgctaaccctggtgagccagaagatgtgtgtggtcgtgtaccccgaggtggagcggggctcagggacagaggaggctaatgaggacatggaggagcagcagcagcccatgtaccaacccactcccacgaaggacaaggacgtggcggggcagccccagccctgaggaccaccattccctggctactctctccttcctcccccttttatcctacctccctgccttggtcctgccaacacatgcgagtacacacacacccctctctctgcttttgtcaggcagtggtaggactttggtgtgggtggtgagaaattgtaaacaaaaactgacattcatacccaaagaaccagcctctcaccccagggtccatgtcccaggccccactccagtgctgcccacactcccagctgctggaggagaggggagatgccaaggtgccctgcaggacctccctccgggccacaccctcagctgcctcttcaggaaccggagctcattactgccttccctcccagggaggccccttcagagaggagaggccacaggagctgcattgtggggggacaggctcaagcaattctgtccccatcaaggggtcagctggagagacccaagaccctatctgttcaccagggacccaaaatccaaggggatgcttccctctgccctctttcctgcccctccccatcatacctgcacccaccccagccagggctccctgtccagaattcggttctcctcaggacgccaactcccagagctaaggaccaaggagaagaacagcctctccacccccaagccaggcggttgaggaacatattgagaaaggttcagattgcagaaacccagccctgcccctgcctcctgcatccagcccccaacatggtgccaaagcttccagaagccaaaaagcttctgatttttaaggtagtgggcatctctctcctaatgacgaagctgctcagcaactccacctgcccgccgcaggaaggagcagtcccctgctatccctgcagccactcccagcacacccgcacacagccagcaccaccgcccccaccgtgcacttctcctctctgggccttggcttgggaccaggtacgaaggatccccaagcccttcaggcctgagatcagagccagatcagccttaagtcacctcccatccaagaacttggcctaaaaatactcccctatttctaaccctcaggacggatctgatattaaatgccttccctgggaggaagggtgctttccccctccctagaggtgcccattccataccctgggagactgaggagagcattggctgaagcccagttcctttcccatccatccccaactccaataatcccccactcctcgcaggtctcagtgtcatgctgtcttggggcagggtgaaagggtagtggcagcagggcgcccactctggagatcctcaaaaaaggccctcctctgtggctggcagcctctgacctttccctgggcttcaaaggaaggctatggagtttgctgtgggccctgcaaccttcccagccactcctgctgcactaaggacttaggatccttttatcacaaatcgggattctctcccccaccccgaattctgtctgcttaaactggaatacacaggagcccttcctggcctggatggtgtctcccagcttccccgcccagcttgcccaccccatagttggtgagatgccaagtttggtctgagttgtgaccccttcagagtagatgcccggcaggctggggttggcccctggagggtcaggggaccatcttcttattccctcttttctcattcctccaacttcctcccctccttcaattatttttttgtaaagttgatgccttactttttggataaatatttttgaagctggtatttctatttcttttggattttttttaatgtaaggttgttttgggggatggagttagaaccttaatgataatttctttcgtttggtgtaggttttagagatttgttttgtggagaggtttttttcttttgatgtaataaaatttaaaatggaaatgaaaaaaaaaaaaaaaaaaaaaaa

SEQ ID NO: 107 - DNA, 2793 bp, Homo sapiens
ctacccctttgtgagcagtctaggactttgtacacctgttaagtagggagaaggcaggggaggtggctggtttaaggggaacttgagggaagtagggaagactcctcttgggacctttggagtaggtgacacatgagcccagccccagctcacctgccaatccagctgaggagctcacctgccaatccagctgaggctgggcagaggtgggtgagaagagggaaaattgcagggacctccagttgggccaggccagaagctgctgtagctttaaccagacagctcagacctgtctggaggctgccagtgacaggttaggtttagggcagagaagaagcaagaccatggtggggaagatgtggcctgtgttgtggacactctgtgcagtcagggtgaccgtcgatgccatctctgtggaaactccgcaggacgttcttcgggcttcgcagggaaagagtgtcaccctgccctgcacctaccacacttccacctccagtcgagagggacttattcaatgggataagctcctcctcactcatacggaaagggtggtcatctggccgttttcaaacaaaaactacatccatggtgagctttataagaatcgcgtcagcatatccaacaatgctgagcagtccgatgcctccatcaccattgatcagctgaccatggctgacaacggcacctacgagtgttctgtctcgctgatgtcagacctggagggcaacaccaagtcacgtgtccgcctgttggtcctcgtgccaccctccaaaccagaatgcggcatcgagggagagaccataattgggaacaacatccagctgacctgccaatcaaaggagggctcaccaacccctcagtacagctggaagaggtacaacatcctgaatcaggagcagcccctggcccagccagcctcaggtcagcctgtctccctgaagaatatctccacagacacatcgggttactacatctgtacctccagcaatgaggaggggacgcagttctgcaacatcacggtggccgtcagatctccctccatgaacgtggccctgtatgtgggcatcgcggtgggcgtggttgcagccctcattatcattggcatcatcatctactgctgctgctgccgagggaaggacgacaacactgaagacaaggaggatgcaaggccgaaccgggaagcctatgaggagccaccagagcagctaagagaactttccagagagagggaggaggaggatgactacaggcaagaagagcagaggagcactgggcgtgaatccccggaccacctcgaccagtgacaggccagcagcagagggcggcggaggaagggttaggggttcattctcccgcttcctggcctcccttctcctttctaagccctgttctcctgtccctccatcccagacattgatggggacatttcttccccagtgtcagctgtggggaacatggctggcctggtaagggggtccctgtgctgatcctgctgacctcactgtcctgtgaagtaacccctcctggctgtgacacctggtgcgggcctggccctcactcaagaccaggctgcagcctccacttccctcgtagttggcaggagctcctggaagcacagcgctgagcatggggcgctcccactcagaactctccagggaggcgatgccagccttggggggtgggggctgtcctgctcacctgtgtgcccagcacctggaggggcaccaggtggagggtttgcactccacacatctttcttgaatgaatgaaagaataagtgagtatgcttgggccctgcattggcctggcctccagctcccactccctttccaacctcacttcccgtagctgccagtatgttccaaaccctcctgggaaggccacctcccactcctgctgcacaggccctggggagcttttgcccacacactttccatctctgcctgtcaatatcgtacctgtccctccaggcccatctcaaatcacaaggatttctctaaccctatcctaattgtccacatacgtggaaacaatcctgttactctgtcccacgtccaatcatgggccacaaggcacagtcttctgagcgagtgctctcactgtattagagcgccagctccttggggcagggcctgggcctcatggcttttgctttccctgaagccctagtagctggcgcccatcctagtgggcacttaagcttaattggggaaactgctttgattggttgtgccttcccttctctggtctccttgagatgatcgtagacacagggatgattcccacccaaacccacgtattcattcagtgagttaaacacgaattgatttaaagtgaacacacacaagggagcttgcttgcagatggtctgagttcttgtgtcctggtaattcctctccaggccagaataattggcatgtctcctcaacccacatggggttcctggttgttcctgcatcccgatacctcagccctggccctgcccagcccatttgggctctggttttctggtggggctgtcctgctgccctcccacagcctccttctgtttgtcgagcatttcttctactcttgagagctcaggcagcgttagggctgcttaggtctcatggaccagtggctggtctcacccaactgcagtttactattgctatcttttctggatgatcagaaaaataattccataaatctattgtctacttgcgattttttaaaaaatgtatatttttatatatattgttaaatcctttgcttcattccaaatgctttcagtaataataaaattgtgggtgg

SEQ ID NO: 108 - DNA, 1575 bp, Homo sapiens
tcccacccccagcctggggcctctgggagccttggtcctgagcagccaacacaccagcccagacagctgcaagtcaccatggacgctgaaggcctggcgctgctgctgccgcccgtcaccctggcagccctggtggacagctggctccgagaggactgcccagggctcaactacgcagccttggtcagcggggcaggcccctcgcaggcggcgctgtgggccaaatcccctggggtactggcagggcagcctttcttcgatgccatatttacccaactcaactgccaagtctcctggttcctccccgagggatcgaagctggtgccggtggccagagtggccgaggtccggggccctgcccactgcctgctgctgggggaacgggtggccctcaacacgctggcccgctgcagtggcattgccagtgctgccgccgctgcagtggaggccgccaggggggccggctggactgggcacgtggcaggcacgaggaagaccacgccaggcttccggctggtggagaagtatgggctcctggtgggcggggccgcctcgcaccgctacgacctgggagggctggtgatggtgaaggataaccatgtggtggccgccggtggcgtggagaaggcggtgcgggcggccagacaggcggctgacttcgctctgaaggtggaagtggaatgcagcagcctgcaggaggccgtgcaggcagctgaggctggtgccgaccttgtcctgctggacaacttcaagccagaggagctgcaccccacggccaccgtgctgaaggcccagttcccgagtgtggctgtggaagccagtgggggcatcaccctggacaacctcccccagttctgcgggccgcacatagacgtcatctccatggggatgctgacccaggcggccccagcccttgatttctccctcaagctgtttgccaaagaggtggctccagtgcccaaaatccactagtcctaaaccggaagaggatgacaccggccatgggttaacgtggctcctcaggaccctctgggtcacacatctttagggtcagtggccaatggggcacatttggcactagcttgagcccaactctggctctgccacctgctgctcctgtgacctgtcagggctgacttcacctctgctcatctcagtttcctaatctgtaaaatgggtctaataaaggatcaaccacatggggttctgcggtgataatgagcacatagtgaggggtcagcaaatgtcagaagttacctgggacagccgggcacgatggctcacacctgtaatcccagcactttgggaggctgaggcgggaagatcacttgagttcaggagtttgagaccagcctggccaacatggtgaaaccccatctctaccaaaaatagaagaattagctgggtgtggtggcacgcgcctgtaatcccagctacttaggaggctgaggcaggagaatcgcttgaacccaggaagtggaggttgcagtgagctgatggtgccactgcactccagcctgggtgatagagcgagactctgtctccaaagaagaaaaaaaaaaaaaaaaaaaaaaa

SEQ ID NO: 109 - DNA, 1953 bp, Homo sapiens
ggagagagagaggacagagagcaagtcactcccggctgcctttttcacctctgacagagcccagacaccatgaacgcaagtgaattccgaaggagagggaaggagatggtggattacgtggccaactacatggaaggcattgagggacgccaggtctaccctgacgtggagcccgggtacctgcggccgctgatccctgccgctgcccctcaggagccagacacgtttgaggacatcatcaacgacgttgagaagataatcatgcctggggtgacgcactggcacagcccctacttcttcgcctacttccccactgccagctcgtacccggccatgcttgcggacatgctgtgcggggccattggctgcatcggcttctcctgggcggcaagcccagcatgcacagagctggagactgtgatgatggactggctcgggaagatgctggaactaccaaaggcatttttgaatgagaaagctggagaagggggaggagtgatccagggaagtgccagtgaagccaccctggtggccctgctggccgctcggaccaaagtgatccatcggctgcaggcagcgtccccagagctcacacaggccgctatcatggagaagctggtggcttactcatccgatcaggcacactcctcagtggaaagagctgggttaattggtggagtgaaattaaaagccatcccctcagatggcaacttcgccatgcgtgcgtctgccctgcaggaagccctggagagagacaaagcggctggcctgattcctttctttatggttgccaccctggggaccacaacatgctgctcctttgacaatctcttagaagtcggtcctatctgcaacaaggaagacatatggctgcacgttgatgcagcctacgcaggcagtgcattcatctgccctgagttccggcaccttctgaatggagtggagtttgcagattcattcaactttaatccccacaaatggctattggtgaattttgactgttctgccatgtgggtgaaaaagagaacagacttaacgggagcctttagactggaccccacttacctgaagcacagccatcaggattcagggcttatcactgactaccggcattggcagataccactgggcagaagatttcgctctttgaaaatgtggtttgtatttaggatgtatggagtcaaaggactgcaggcttatatccgcaagcatgtccagctgtcccatgagtttgagtcactggtgcgccaggatccccgctttgaaatctgtgtggaagtcattctggggcttgtctgctttcggctaaagggttccaacaaagtgaatgaagctcttctgcaaagaataaacagtgccaaaaaaatccacttggttccatgtcacctcagggacaagtttgtcctgcgctttgccatctgttctcgcacggtggaatctgcccatgtgcagcgggcctgggaacacatcaaagagctggcggccgacgtgctgcgagcagagagggagtaggagtgaagccagctgcaggaatcaaaaattgaagagagatatatctgaaaactggaataagaagcaaataaatatcatcctgccttcatggaactcagctgtctgtggcttcccatgtctttctccaaagttatccagagggttgtgattttgtctgcttagtatctcatcaacaaagaaatattatttgctaattaaaaagttaatcttcatggccatagcttttattcattagctgtgatttttgttgattaaaacattatagattttcatgttcttgcagtcatcagaagtggtaggaaagcctcactgatatattttccagggcaatcaatgttcacgcaacttgaaattatatctgtggtcttcaaattgtcttttgtcatgtggctaaatgcctaataaacaattcaagtgaaatactaaaaaaaaaaaaaaaaa

SEQ ID NO: 110 - DNA, 7291 bp, Homo sapiens
acacagtactctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgagtatgcaccagaggatataatcgaatatgactatgagtatggggaagcagagtataaagaggctgaaagtgtaacagagggacccactgtaactgaggagacaatagcacagacggaggcaaacatcgttgatgattttcaagaatacaactatggaacaatggaaagttaccagacagaagctcctaggcatgtttctgggacaaatgagccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttggtccaggtgtaccagcagaaactgatattacagaaacaagcataaatggccatggtgcatatggagagaaaggacagaaaggagaaccagcagtggttgagcctggtatgcttgtcgaaggaccaccaggaccagcaggacctgcaggtattatgggtcctccaggtctacaaggccccactggaccccctggtgaccctggcgataggggccccccaggacgtcctggcttaccaggggctgatggtctacctggtcctcctggtactatgttgatgttaccgttccgttatggtggtgatggttccaaaggaccaaccatctctgctcaggaagctcaggctcaagctattcttcagcaggctcggattgctctgagaggcccacctggcccaatgggtctaactggaagaccaggtcctgtgggggggcctggttcatctggggccaaaggtgagagtggtgatccaggtcctcagggccctcgaggcgtccagggtccccctggtccaacgggaaaacctggaaaaaggggtcgtccaggtgcagatggaggaagaggaatgccaggagaacctggggcaaagggagatcgagggtttgatggacttccgggtctgccaggtgacaaaggtcacaggggtgaacgaggtcctcaaggtcctccaggtcctcctggtgatgatggaatgaggggagaagatggagaaattggaccaagaggtcttccaggtgaagctggcccacgaggtttgctgggtccaaggggaactccaggagctccagggcagcctggtatggcaggtgtagatggccccccaggaccaaaagggaacatgggtccccaaggggagcctgggcctccaggtcaacaagggaatccaggacctcagggtcttcctggtccacaaggtccaattggtcctcctggtgaaaaaggaccacaaggaaaaccaggacttgctggacttcctggtgctgatgggcctcctggtcatcctgggaaagaaggccagtctggagaaaagggggctctgggtccccctggtccacaaggtcctattggatacccgggcccccggggagtaaagggagcagatggtgtcagaggtctcaagggatctaaaggtgaaaagggtgaagatggttttccaggattcaaaggtgacatgggtctaaaaggtgacagaggagaagttggtcaaattggcccaagaggggaagatggccctgaaggacccaaaggtcgagcaggcccaactggagacccaggtccttcaggtcaagcaggagaaaagggaaaacttggagttccaggattaccaggatatccaggaagacaaggtccaaagggttccactggattccctgggtttccaggtgccaatggagagaaaggtgcacggggagtagctggcaaaccaggccctcggggtcagcgtggtccaacgggtcctcgaggttcaagaggtgcaagaggtcccactgggaaacctgggccaaagggcacttcaggtggcgatggccctcctggccctccaggtgaaagaggtcctcaaggacctcagggtccagttggattccctggaccaaaaggccctcctggaccacctgggaaggatgggctgccaggacaccctgggcaacgtggggagactggatttcaaggcaagaccggccctcctgggccagggggagtggttggaccacagggaccaaccggtgagactggtccaataggggaacgtgggcatcctggccctcctggccctcctggtgagcaaggtcttcctggtgctgcaggaaaagaaggtgcaaagggtgatccaggtcctcaaggtatctcagggaaagatggaccagcaggattacgtggtttcccaggggaaagaggtcttcctggagctcagggtgcacctggactgaaaggaggggaaggtccccagggcccaccaggtccagttggctcaccaggagaacgtgggtcagcaggtacagctggcccaattggtttaccagggcgcccgggacctcagggtcctcctggtccagctggagagaaaggtgctcctggagaaaaaggtccccaagggcctgcagggagagatggagttcaaggtcctgttggtctcccagggccagctggtcctgccggctcccctggggaagacggagacaagggtgaaattggtgagccgggacaaaaaggcagcaagggtgacaagggagaaaatggccctcccggtcccccaggtcttcaaggaccagttggtgcccctggaattgctggaggtgatggtgaaccaggtcctagaggacagcaggggatgtttgggcaaaaaggtgatgagggtgccagaggcttccctggacctcctggtccaataggtcttcagggtctgccaggcccacctggtgaaaaaggtgaaaatggggatgttggtcccatggggccacctggtcctccaggcccaagaggccctcaaggtcccaatggagctgatggaccacaaggacccccagggtctgttggttcagttggtggtgttggagaaaagggtgaacctggagaagcagggaacccagggcctcctggggaagcaggtgtaggcggtcccaaaggagaaagaggagagaaaggggaagctggtccacctggagctgctggacctccaggtgccaaggggccaccaggtgatgatggccctaagggtaacccgggtcctgttggttttcctggagatcctggtcctcctggggaacctggccctgcaggtcaagatggtgttggtggtgacaagggtgaagatggagatcctggtcaaccgggtcctcctggcccatctggtgaggctggcccaccaggtcctcctggaaaacgaggtcctcctggagctgcaggtgcagagggaagacaaggtgaaaaaggtgctaagggggaagcaggtgcagaaggtcctcctggaaaaaccggcccagtcggtcctcagggacctgcaggaaagcctggtccagaaggtcttcggggcatccctggtcctgtgggagaacaaggtctccctggagctgcaggccaagatggaccacctggtcctatgggacctcctggcttacctggtctcaaaggtgaccctggctccaagggtgaaaagggacatcctggtttaattggcctgattggtcctccaggagaacaaggggaaaaaggtgaccgagggctccctggaactcaaggatctccaggagcaaaaggggatgggggaattcctggtcctgctggtcccttaggtccacctggtcctccaggtttaccaggtcctcaaggcccaaagggtaacaaaggctctactggacccgctggccagaaaggtgacagtggtcttccagggcctcctgggtctccaggtccacctggtgaagtcattcagcctttaccaatcttgtcctccaaaaaaacgagaagacatactgaaggcatgcaagcagatgcagatgataatattcttgattactcggatggaatggaagaaatatttggttccctcaattccctgaaacaagacattgagcatatgaaatttccaatgggtactcagaccaatccagcccgaacttgtaaagacctgcaactcagccatcctgacttcccagatggtgaatattggattgatcctaaccaaggttgctcaggagattccttcaaagtttactgtaatttcacatctggtggtgagacttgcatttatccagacaaaaaatctgagggagtaagaatttcatcatggccaaaggagaaaccaggaagttggtttagtgaatttaagaggggaaaactgctttcatacttagatgttgaaggaaattccatcaatatggtgcaaatgacattcctgaaacttctgactgcctctgctcggcaaaatttcacctaccactgtcatcagtcagcagcctggtatgatgtgtcatcaggaagttatgacaaagcacttcgcttcctgggatcaaatgatgaggagatgtcctatgacaataatccttttatcaaaacactgtatgatggttgtgcgtccagaaaaggctatgaaaagactgtcattgaaatcaatacaccaaaaattgatcaagtacctattgttgatgtcatgatcaatgactttggtgatcagaatcagaagttcggatttgaagttggtcctgtttgttttcttggctaagattaagacaaagaacatatcaaatcaacagaaaatataccttggtgccaccaacccattttgtgccacatgcaagttttgaataaggatggtatagaaaacaacgctgcatatacaggtaccatttaggaaataccgatgcctttgtgggggcagaatcacatggcaaaagctttgaaaatcataaagatataagttggtgtggctaagatggaaacagggctgattcttgattcccaattctcaactctccttttcctatttgaatttctttggtgctgtagaaaacaaaaaaagaaaaatatatattcataaaaaatatggtgctcattctcatccatccaggatgtactaaaacagtgtgtttaataaattgtaattattttgtgtacagttctatactgttatctgtgtccatttccaaaacttgcacgtgtccctgaattccatctgactctaattttatgagaattgcagaactctgatggcaataaatatatgtattatgaaaaaataaagttgtaatttctgatgactctaagtccctttctttggttaataataaaatgcctttgtatatattgatgttgaagagttcaattatttgatgtcgccaacaaaattctcagagggcaaaaatctggaagacttttggaagcacactctgatcaactcttctctgccgacagtcattttgctgaatttcagccaaaaatattatgcattttgatgctttattcaaggctatacctcaaactttttcttctcagaatccaggatttcacaggatacttgtatatatggaaaacaagcaagtttatatttttggacagggaaatgtgtgtaagaaagtatattaacaaatcaatgcctccgtcaagcaaacaatcatatgtatactttttttctacgttatctcatctccttgttttcagtgtgcttcaataatgcaggttaatattaaagatggaaattaagcaattatttatgaatttgtgcaatgttagattttcttatcaatcaagttcttgaatttgattctaagttgcatattataacagtctcgaaaattattttacttgcccaacaaatattacttttttcctttcaagataattttataaatcatttgacctacctaattgctaaatgaataacatatggtggactgttattaagagtatttgttttaagtcattcaggaaaatctaaacttttttttccactaaggtatttactttaaggtagcttgaaatagcaatacaatttaaaaattaaaaactgaattttgtatctattttaagtaatatatgtaagacttgaaaataaatgttttatttcttatataaagtgttaaattaattgataccagatttcactggaacagtttcaactgataatttatgacaaaagaacatacctgtaatattgaaattaaaaagtgaaatttgtcataaagaatttcttttatttttgaaatcgagtttgtaaatgtccttttaagaagggagatatgaatccaataaataaactcaagtcttggctacctgga

SEQ ID NO: 111 - DNA, 3856 bp, Homo sapiens
aacgccgggcagggcggcgggcgcgctcagtctggcggcggctgccgtgagctgactgacgttccgggaacgccgcagcagcccgcgccgcccgcagcctagccgagccgcgccgcccgggcctcgcccgcccgcctgcccgccatggtgtcatggatcatctccaggctggtggtgcttatatttggcaccctttaccctgcgtattattcctacaaggctgtgaaatcaaaggacattaaggaatatgtcaaatggatgatgtactggattatatttgcacttttcaccacagcagagacattcacagacatcttcctttgttggtttccattctattatgaactaaaaatagcatttgtagcctggctgctgtctccctacacaaaaggctccagcctcctgtacaggaagtttgtacatcccacactatcttcaaaagaaaaggaaatcgatgattgtctggtccaagcaaaagaccgaagttacgatgcccttgtgcacttcgggaagcggggcttgaacgtggccgccacagcggctgtgatggctgcttccaagggacagggtgccttatcggagagactgcggagcttcagcatgcaggacctcaccaccatcaggggagacggcgcccctgctccctcgggccccccaccaccggggtctgggcgggccagcggcaaacacggccagcctaagatgtccaggagtgcttctgagagcgctagcagctcaggcaccgcctagaatccttcgatctcgcttcaggaagaaaagtacctcatcctcggccaccgaaaccacgtgagtgagatgagccaacagcaccggatccacagaatgtttcttctctgccttaaagagctattcactaataacatagaaatccgcaagctgggtgtgctttgagtgtgcagcctcacaaacatggccttttctctctccccttccacttttaaggatttatttttttcccccttttctttattttgctggggagaggctaaagggaaaggtagtaggggcgggggtggtgacctttaagtcttctgaggttggtaattttccacaattggattgtcattatagacagcagtgtgttttttagaaagataagagaatcacccctatgctgctgagatgtacatttgtaatttatctgttgcatacttagtttttagtcctgtaaatgcaaacacagcattttttacaactttctttgttcttggtacttatactttgaactatgatgtacatatttatggcttttggcttttaatataatggacttgcaagggctgccagaggttctgatatgtaagaaaactgcaaaaacaaatatagacaaatattttgattctagagaacgtctcagatgtgcttataaagcttccaaatacaactccagtaagacatccctttccctgcaggagtgtggtctatattctttagatagttgtttagtcaaaagaccagacaagttacaaactaagagaaacaatatttcacaacacagtaaagtgtgatgagaggtcaggggaacatcccagtaaaagagaagagtcacaggaagctcatctcctccctggattctggattaggagcttctgaatcttttccagggataggcaggtagctcactcttggtgcaatttcttgaggatgggaacatgtagagctgctggaaggagtaattctgtgcttgacaaaggacgatttctcctttatcgtgaccagtgctgccgatttcctgacagaggagcttacactctgagcaccttgttttagcgaactctagcaaaacttgtttagcttagcaaaaacaaacacacaaaaaactgagaactctgctgtttcagatatgccataacatacatctgaaacacatgtgtaacaatcaaaatggtgggctctagaatggttttggagctcgagatcttcatgggttagacttgctggtcagacccaggagcacctgtggctcacaccttctgttcccctcctggcctgtgcagaatgtaaacagcagactcatactcaatgggcactacaggccttatcagacgttttatacaagcctggattgcttagtaggggaataaggcattctctgagggggctttccacttagattgagaattttatttgaaaagaatctggtttaaatggcattgtggtccgaggtagctgctctccccactgagagctgagccgaaatataagaataatatatttgtgcttcgagttggtgtttctttcagtgtaatgcatgcagtggtcacaacccagttactcataatatttggattgtatttgttcgtagatatgcccagaagactagagaattagtgttatataccatatagaacttactgtcagtcaactataaacaggcccaattaaaaactgttccattactacgcaaacacatattagaggcctttgctgatgacacattagctggatcttagccaccccagaaagggtttgatttgaagctgattgttgccagatatgcatattggaatcccatctacccatagttcctctgaaggtgattttgtaatttgcaaaagggtataggaaaatatacctaaaagcgaatttgtggctgagaggataaacagaagctgtttgctcatgttctgtgccccacacccaccaatacctaaatctgttaaggaagacagaaaatgttttctttgtgctcattgagtagttccagacagaagaagaatatactctttaaaatgtatttacctgttagttggaagtacccagaattatcagaaacgaatgcaaaaaaaaaaaaaaaaaaaaaaagcttacacagcttcttagcaattttttttttttttgccgaaacaataaattgcctttagcagcagtttaaaatcctatcgtgaacaacctatattttcgccattttacaatggagagttgtgacaagtacaggttatcaagtttgcacttaactatgccaaaaaaagtttgaagcgctctattctcagacatgctgtattattacttctcattcaagattgaaaaatataaaggtatccaaactctgtcttaatgtaaatgtaactatttttccttcaagtgttgactagggagtcggtttctctcttaaagacactcactgtacaactgaaagcagctgtcatatttctggcaaaatgtgtttacgtatctgacaagttgtacatttgtgtatgaactgacataaaatgtgaaagcctgtaagtgtacatgtagtggtgtggtgttctgtctagaggatacaactgaatgtttttaatttgctgacttacagacacaggctgtttacaaaatgctagctggaaagtctgtaatgttcatgtcataacttttagttaattgccattgagcacctgttctgaggaggtgagatgtggacttgtgcttataaactggagagtttagtcataatccctcctggctttgtgtgaatagcttgctcactttgctggcctttgaaatgtgttctccgtgataagctatccatgtgtttgtgataagagtgcttgtcaaccatgaccatctttgagccttcctagtcctccacctggcacagtatttgaaatggcaaaggatgtgcttcatcctctaacaaacagtgtacactcccagagctgatattctggattgtgactgtgcacatttcctctagttcatgtctgtagtccctatagaatgatctgtaataaaatagtatactggactgtgcatcaaagggatgtaaaattacagtattccaaaggttgaagttctgctgttttgttataatgcctgatacacatcttgaataaagtcttaacatttttctttt

SEQ ID NO: 112 - DNA, 5699 bp, Homo sapiens; identical to SEQ ID NO: 85

SEQ ID NO: 113 - DNA, 1510 bp, Homo sapiens
atcctgctgctgccgccaccgctgctgctgctctgcaaaattcagctgctgcctctgtcttgaggaccccagcgcctttcccccggggccatgctgcctgcagccacagcctccctcctggggcccctcctcactgcctgcgccctgctgccttttgcccagggccagacccccaactacaccagacccgtgttcctgtgcggaggggatgtgaagggggaatcaggttacgtggcaagtgaggggttccccaactcctacccccctaataaggagtgcatctggaccataacggtccccgagggccagactgtgtccctctcattccgagtcttcgacctggagctgcaccccgcctgccgctacgatgctctggaggtcttcgctgggtctgggacttccggccagcggctcggacgcttttgtgggaccttccggcctgcgcccctagtcgcccccggcaaccaggtgaccctgaggatgacgacggatgagggcacaggaggacgaggcttcctgctctggtacagcgggcgggccacctcgggctctgagcaccaattttgcggggggcggctggagaaggcccagggaaccctgaccacgcccaactggcccgagtccgattaccccccgggcatcagctgttcctggcacatcatcgcgcccccggaccaggtcatcgcgctgaccttcgagaagtttgacctggagccggacacctactgccgctatgactcggtcagcgtcttcaacggagccgtgagcgacgactcccggaggctggggaagttctgcggcgacgcagtcccgggctccatctcctccgaagggaatgaactcctcgtccagttcgtctcagatctcagtgtcaccgctgatggcttctcagcctcctacaagaccctgccgcggggcactgccaaagaagggcaagggcccggccccaaacggggaactgagcctaaagtcaagctgccccccaagtcccaacctccggagaaaacagaggaatctccttcagcccctgatgcacccacctgcccaaagcagtgccgccggacaggcaccttgcagagcaacttctgtgccagcagccttgtggtgactgcgacagtgaagtccatggttcgggagccaggggagggccttgccgtgactgtcagtcttattggtgcttataaaactggaggactggacctgccaactccacccactggtgcctccctgaagttttacgtgccttgcaagcagtgcccccccatgaagaaaggagtcagttatctgctgatgggccaggtagaagagaacagaggccccgtccttcctccagagagctttgtggttctccaccggcccaaccaggaccagatcctcaccaacctaagcaagaggaagtgcccctctcaacctgtgcgggctgctgcgtcccaggactgagacgcaggccagccccggcccctagccctcaggcctctcttcttatccaaataaatgtttcttaatgaaa

SEQ ID NO: 114 - DNA, 9217 bp, Homo sapiens
ggcaagtccattgaggtctcggtggatgtgtctgcgccgaagtggaggccgaagtgagcctcccctccatgcagggggacctgaagaccactgacatcagcattgagcccccctctgcccaactggaggtccaggctggccaggtggacctgaagctcccagagggccacgttcccgagggagctggcctcaaagggcacctgcccaagttgcagatgcccagtttcaagatgcccaaagtagatcgcaagggaccccagatagatgtcaagggccccaagctggacctgaaaggcccgaagacggacgtgacggcccccgacgtggaggtgtctcagcccggcatggaggtggatgtcgaggccccaggagccaagttggatggtgcacggctggagggggacctgtccctggccgacaaggatgtgactgccaaagacagcaagttcaaaatgcccaagttcaagatgccgtcgttcggggtgtctgccccaggcaagtccattgaggtcttggtggatgtgtctgcgccaaaggtggaggccgacctgagcctcccctccatgcagggggacctgaagaacactgacatcagcattgagctcccttctgtccaactggaggtccaggctggccaggtggacgtgaagctcccagagggccacgttctcgagggagctggcctcaaagggcacctgcccaagttgcagatgcccagtttcaagatgcccaaagtagatcgcaagggcccccagatagacatcaagggccccaagctggacctgaaaggcccgaagatggatgtgacggcccccgacgtggaggtgtctcagcccagcatggaggtggacgtcgaggccccaggagccaagttggatggtgcacggctggagggggacctgtccctggccgacaaggatgtgactgccaaagacagcaagttcaaaatgcccaaattcaagatgccgtcgtacagggcgtctgccccaggcaagtccatccaggcctcggtggatgtgtctgcgccgaaggcggaggccgacgtgagcctcccctccatgcagggggacctcaagaccactgacctcagcattcagctcccttctgtggacctggaggtccaggctggccaggtggacgtgaagctcccggagggccacgtgcccgagggagctggcctcaaagggcacctgcccaaggtggagatgcccagtttcaagatgcccaaagtggacctcaagagcccccaggtggacatcaagggccccaagctggacctaaaagtccccaaggcggaagtgacagtccctgatgtggaggtgtctctgcccagcgtggaggtggacgtccaggccccgagagccaagctggatggtgcgcggctggagggggacctgtccctggctgaaaaggatgtgactgccaaagacagcaagttcaaaatgcccaagttcaagatgccctccttcggggtgtcggccccaggcaggtccatcgaggcctcgctggatgtgtctgcgccgaaggtggaggccgacgtgagcctctcctccatgcagggggacctcaaggccactgacctcagcattcagcccccttccgctgacctggaggtccaggctgtccaagtggatgtggaactcctggagggccccgtgcccgagggagccggcctcaaagggcacctgcccaaagtggagatgcccagtttaaagacgcccaaagtggacctcaagggcccccagatagatgttaagggccccaagctggacctgaaaggccccaaggcagaagtgagagtccccgatgtcgaggtgtctctgcccagcgtggaggtggatgtccaggccccgaaggccaagctggatgctgggcggctggagggagacctgtccctggctgacaaggacgtgactgccaaagacagcaagttcaaaatgcccaaattcaagatgccgtcattcagggtatcggccccagggaagtccatggaggcctcggtggatgtgtctgcacccaaggtggaagccgatgtgagtctcccctccatgcagggggacctgaagaccactgacctcagcattcagcccccttctgccgacctgaaggtccaggctggccagatggatgtgaagctcccggagggccaggtgcccgagggagccggcctcaaagagcacctgcccaaggtggagatgcccagtttgaagatgcccaaagtggacctcaagggcccccaggtggacatcaagggccccaagctggacctaaaagtctccaaggcggaagtcacagcccctgatgtggaggtgtctctgcccagcgtggaggtggacgtccaggccccaagagccaaactggatagtgcacagctggagggggacctgtccctggccgacaaggatgtgactgccaaagacagcaaattcaaaatgcccaagttcaagatgccgtcatttggggtgtctgccccaggcaagtccattgaggcctcggtgcacgtgtctgcacccaaggtggaggccgatgtgagtctcccctccatgcagggggacctcaagaccactgacctcagcattcagccccattctgccgacctgacggtccaagctcgccaggtggacatgaaactcctggagggccacgtgcccgaggaagccggcctcaaaggacacctgcccaaggtgcagatgcccagtttcaagatgcccaaagtcgacctcaagggccctgaaatagacatcaagggccccaagctggacctaaaagaccccaaggtggaagtgacagcccctgatgtggaggtttctctgcccagcgtggaggtggacgtcgaggccccaggagccaagctggatggtgcgcggctggagggggacctgtccctggccgacaaggacatgacggccaaagacagcaagttcaaaatgcccaagttcaagatgccgtcgttcggggtgtctgccccaggcaagtccatggaggcatcagtggatgtgaccgcgccaaaggtggaggccgacgtgagcctcccttccatgcagggggacctcaaggccactgacctcagcgttcagcccccttccgctgacctggaggtccaggctggccaagtggacgtgaaactcccagagggccccgtgcccgagggagccagcctcaaagggcacctgcccaaggtgcagatgcccagtttcaagatgcccaaagtggacctcaagggcccccagatagatgttaagggccccaagctggacctgaaaggccccaaggcggaagtgacagcccctgatgtgaagatgtctctgtccagcatggaggtggacgtccaggccccgagagcaaagctggatggtgtgcagctggagggggacctgtccctggccgacaaggatgtgactgccaaagacagcaagttcaaaatgcccaagttcaagatgccatcattcggggtgtcggccccaggcaagtccatggaggcgtccgtggatgtgtctgagctgaaggcgaaagccgacgtgagcctcccctccatgcagggggacctcaagaccactgacctcagcattcagtccccttccgccgacctggaggtccaggctggccaagtggacgtgaaactcccggagggccccctgcccaagggagccggcctcaaagggcacctccccaaggtgcagatgccctgtttgaagatgcccaaagtggccctcaagggcccccaggtggatgtcaagggccccaagctggacctgaaaggccccaaggcggatgtgatgacccccgtcgtggaggtgtctctgcccagcatggaggtggacgtcgaggccccgggagccaagctggacagtgtgcggctggagggtgacctgtccctagccgacaaggacatgactgccaaagacagcaagttcaaaatgcccaagttcaagatgccgtcgttcggggtgtctgccccaggcaagtccatcgaggcctcgttggatgtgtctgcgctgaaggtggaggctgacgtgagcctcccctccatgcagggggacctgaagaccactcacctcagcattcagcccccttccgctgatctggaggtccaggctggccaagaggatgtgaaactcccagagggccctgtgcatgagggagccggcctcaaagggcacctgccgaagctgcagatgcccagtttcaaggtacccaaagtggacctcaagggtccccagatagacgttaatgtccccaagctggacctgaaaggccccaaggtggaggtgacgtcccccaacctggacgtgtctctgcccagcatggaggtggacatccaagccccaggagccaagctggacagtacgcggctggagggggacctgtccctggctgacaaggacgtgactgccaaagacagcaagttcaaaatgcccaagttcaagatgccatcctttgggatgttgtccccaggcaagtccatcgaggtctcggtggatgtgtctgcgccaaagatggaggccgacatgagcattccctccatgcagggggacctcaagaccactgacctccgcattcaggccccttccgccgacctggaggtccaggctggccaggtggacttgaaacttccagaaggccacatgcccgaggtagccggcctcaaagggcacctgcccaaggtggagatgcccagtttcaagatgcccaaagtggacctcaagggcccccaggtggacgtcaagggccccaagctggacctgaaaggcccaaaggcagaggtgatggcccccgatgtggaggtgtctctgcccagcgtggagacggatgtccaggccccaggatccatgctggatggtgcgcggcttgagggggacctgtccctggcccacgaggatgtagctgggaaagacagtaagtttcaaggaccaaaactgagcacgtctggttttgaatggtcgtcaaagaaagtttccatgtcttcctctgaaatcgaaggaaatgttacattccatgagaagacttccacatttcccattgtggaatctgttgttcatgaaggtgatcttcatgatccatctcgcgatggtaacttggggcttgctgttggagaagttggaatggattcgaagtttaagaaactgcattttaaagtgcccaaagtttcattttcttctaccaaaactcctaaagatagtttagtcccaggtgcaaagtctagcataggtctttccacgattcctttatcatcttcagaatgctcaagttttgaattacaacaggtttcggcttgttcagagccatccatgcagatgcctaaggtgggttttgctgggtttccatcatcccggcttgatctcactggtcctcactttgaatcttctattctctctccctgtgaggatgttacacttacaaaataccaggtgactgttcccagagctgccttggcccctgagcttgctctggaaattccttctgggtctcaggctgatattcctcttcccaagacagagtgctccactgacctgcagcctccagagggagttccaacatctcaagctgagagtcactctggcccactgaattccatgattcctgtttctcttggtcaggtatcttttcctaaattctataaaccaaagtttgtgttttcagtcccccaaatggcagttcctgagggagacctacatgcagcagtgggtgccccagtcatgtctcctcttagccctggagaaagagtgcagtgccccttgccaagcacccagctgccatccccaggcacctgtgtgtctcagggcccagaagagcttgtggcctccttgcagacatcagtagtggcccctggagaagccccttctgaagatgctgaccacgaagggaaagggagtcccttgaaaatgcctaagattaagcttccatcatttaggtggtccccgaagaaggaaacagggccaaaggtggacccagaatgcagcgtggaggactcaaaactcagcctggttttagacaaggatgaagtggccccgcagtctgccatccacatggatctgcctcctgagagggatggagagaaggggaggagcacaaagcctggctttgccatgccaaaacttgcacttcccaaaatgaaggcttctaagagtggggtcagcctgccacagagagacgtggatccttccctttctagtgccacagcagggggtagctttcaagacacagaaaaggccagcagtgacggtggtaggggaggacttggtgcaacagcaagtgccacaggaagtgagggtgtgaacctccaccggccacaggtccacattcccagtttgggctttgccaaacctgatctcagatcctccaaggccaaggtggaggtgagccagcctgaagctgacctgcctcttcccaaacatgatctgtctaccgaaggtgacagcagaggatgtgggctcggggatgtcccagtgagccagccttgtggggaggggatagcccccacacctgaagatcccctccagccatcctgtagaaaaccagatgctgaagtcctcacagtggaaagcccagaggaggaagccatgaccaagtactcgcaggaaagctggtttaaaatgcccaagttccgcatgcccagccttaggcgctctttcagggacagaggcggggctggaaagctggaagtggctcagacacaggcaccggcagcaacagggggtgaagcagcagctaaagtcaaagagttccttgtttctgggtcaaacgtggaggcagctatgtccctacagctcccagaggcagatgcagaagtgacagcttctgagagcaaatcatccacagatattctaaggtgtgatcttgacagcacaggcttgaagctgcacctctccactgctgggatgactggggatgagctttccacttctgaggtcaggatccatccatccaaaggacctctcccttttcagatgcctggcatgaggcttccagaaacccaggttcttccaggagaaatagatgagactcctctttccaagccaggacatgaccttgccagcatggaggataaaacagagaaatggtcttcccagcctgaaggtccacttaaattgaaagcttcaagtactgatatgccatcccagatttctgtggttaatgtggatcaactgtgggaagattctgtcctaactgtcaaattccccaaattaatggtaccaaggttctccttccctgcccccagctcagaggatgatgtgttcatccccactgtgagggaagtgcagtgtccagaggccaatattgatacagccctttgtaaggaaagtccggggctctggggagccagcatcctgaaggcaggtgctggggtccctggggagcagcctgtggaccttaacctgcctttggaagctcccccaatttcaaaggtcagagtgcatattcagggtgctcaggttgaaagtcaagaggtcactatacacagcatagtgacaccagagtttgtagatctctcagtacccaggactttttccactcagattgtgcgggaatcagagatccccacgtcagagattcaaacaccttcgtacggattttccttattaaaagtgaaaatcccagagccccacacgcaggctagagtgtacacaacaatgactcaacactctaggactcaggagggcacagaagaggctcccatacaagccaccccaggagtagactccatttctggagatctccagcctgacactggagaaccatttgagatgatctcttccagcgtcaatgtactgggacagcaaacactcacatttgaagttccttctggccaccagcttgcagacagctgttcagatgaggagccagcagaaattcttgagtttccccctgatgatagccaagaggcaaccacaccactggcagatgaaggcagggctccaaaagacaaaccagaaagtaaaaaatctggtctgctctggttttggcttccaaacattgggttttcctcttctgttgatgagacaggtgttgattccaaaaatgacgtccagagatctgctcccattcaaacacagcctgaggcacgaccagaggcagaactgcctaaaaaacaggagaaggcaggctggttccgatttcccaaattagggttctcctcatctcctaccaagaaaagcaaaagcaccgaagatggggcagagctggaagaacaaaaacttcaagaagaaacaatcacgttttttgatgcccgagaaagtttctcccctgaagagaaggaagagggtgaactgatcgggcctgtgggcactgggctggactccagagtgatggtgacatccgcggcaagaacagagttaatcctgcccgagcaggacagaaaagctgacgatgaaagcaaagggtcaggcctgggaccaaatgaaggctgagaggtatggctcatcagtacaagagagatgcaaaaaactaagttggaaagtaaaggctacacacacatatggagcaccccatcccacagcacattacatccacctcacttcacagaacggagaacagagcagaaatgaccagaacacctttgtcaccatcacacagccctcctaaaatggaaccaaagcttcccagctccctcaaagctttggatgcaaagaaggcaccctgacttccacaagacaccagaattcacacggtactcagaggcactgctggggaagtttgttggtctttattagataaatttccagagacctgtccataatacccaacagaacatgactgtttctttgaggaaagggttataatgtctgtggtgtacaagtcgtttttggtataacttctttcctgctgctgctgcttcccggcaaacatagttttcctatttcaggcagagtgcggtatattccaggaaacactgtttcctactcacttagcttacttctttgttgaatgcctcactaatggcaagtttcaagatgttttgggtgacaatgcacacatgctgggcaaaagggtgatggccagtggctggcagctgggccagcagaagctaggacatctgtgagttgtcattctcatctatccatgtccactggcctgccagcatccgccagtgccttgccagtgtgcacggtcccacactgtggcccctgagtcccctaatgtacacgctgcagccagaatgcagatggagctggcttggctgttccctggatgggcaataaagaaagtgctgcatccc

SEQ ID NO: 115 - DNA, 1691 bp, Homo sapiens; identical to SEQ ID NO: 30

SEQ ID NO: 116 - DNA, 11185 bp, Homo sapiens; identical to SEQ ID NO: 38

SEQ ID NO: 117 - DNA, 1542 bp, Homo sapiens
ggtcgctttaagaaaggagtagctgtaatctgaagcctgctggacgctggattagaaggcagcaaaaaaagctctgtgctggctggagccccctcagtgtgcaggcttagagggactaggctgggtgtggagctgcagcgtatccacaggccccaggatgcaggccctggtgctactcctctgcattggagccctcctcgggcacagcagctgccagaaccctgccagccccccggaggagggctccccagaccccgacagcacaggggcgctggtggaggaggaggatcctttcttcaaagtccccgtgaacaagctggcagcggctgtctccaacttcggctatgacctgtaccgggtgcgatccagcacgagccccacgaccaacgtgctcctgtctcctctcagtgtggccacggccctctcggccctctcgctgggagcggagcagcgaacagaatccatcattcaccgggctctctactatgacttgatcagcagcccagacatccatggtacctataaggagctccttgacacggtcactgccccccagaagaacctcaagagtgcctcccggatcgtctttgagaagaagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggatgaagagaggaccgtgagggtccccatgatgtcggaccctaaggctgttttacgctatggcttggattcagatctcagctgcaagattgcccagctgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttatgaaggcgaagtcaccaagtccctgcaggagatgaagctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatccctaacttctgtta

SEQ ID NO: 118 - DNA, 5400 bp, Homo sapiens
ccgccaagcatattgctaggcacagagcaggtgtgcaacaaaagttatttctcaggctttccctcctctgagcgccgtcctccagagggtccggagtgtagctgggggttggagcagcagcctcctaggcgatgggacagagcccacagggtccggtatgccacggtttcttcgtcagaccctgggaatccaacgtcgcaaaataaacacggccgcgccgctaatcgccagttcggaggaaacaaaacagcgctgcgctgggggatctgggcaaaatcagccctccctcctcccgctccttcgccgcggccctcccctcctcgcgctgctctcgttcgcttggctcagctcagctcagctcagcgcagctccgcggccgccaagccgaggcgggcacggtctccgagtcgcggacgccagctccgagctccctctctccgccgcgcctccgccaggtcgcgccttcgtcgggaccacttcgggcaggagtcgcgtggcgaaggcctgcggccgcggcacaaagttgggggccgcgaagatgaggctgtccccggcgcccctgaagctgagccggactccggcactgctggccctggcgctgcccctggccgcggcgctggccttctccgacgagaccctggacaaagtgcccaagtcagagggctactgcagccgtatcctgcgcgcccagggcacgcggcgcgagggctacaccgagttcagcctccgcgtggagggcgaccccgacttctacaagccgggaaccagctaccgcgtaacactttcagctgctcctccctcctacttcagaggattcacattaattgccctcagagagaacagagagggtgataaggaagaagaccatgctgggaccttccagatcatagacgaagaagaaactcagtttatgagcaattgccctgttgcagtcactgaaagcactccacggaggaggacccggatccaggtgttttggatagcaccaccagcgggaacaggctgcgtgattctgaaggccagcatcgtacaaaaacgcattatttattttcaagatgagggctctctgaccaagaaactttgtgaacaagattccacatttgatggggtgactgacaaacccatcttagactgctgtgcctgcggaactgccaagtacagactcacattttatgggaattggtccgagaagacacacccaaaggattaccctcgtcgggccaaccactggtctgcgatcatcggaggatcccactccaagaattatgtactgtgggaatatggaggatatgccagcgaaggcgtcaaacaagttgcagaattgggctcacccgtgaaaatggaggaagaaattcgacaacagagtgatgaggtcctcaccgtcatcaaagccaaagcccaatggccagcctggcagcctctcaacgtgagagcagcaccttcagctgaattttccgtggacagaacgcgccatttaatgtccttcctgaccatgatgggccctagtcccgactggaacgtaggcttatctgcagaagatctgtgcaccaaggaatgtggctgggtccagaaggtggtgcaagacctgattccctgggacgctggcaccgacagcggggtgacctatgagtcacccaacaaacccaccattccccaggagaaaatccggcccctgaccagcctggaccatcctcagagtcctttctatgacccagagggtgggtccatcactcaagtagccagagttgtcatcgagagaatcgcacggaagggtgaacaatgcaatattgtacctgacaatgtcgatgatattgtagctgacctggctccagaagagaaagatgaagatgacacccctgaaacctgcatctactccaactggtccccatggtccgcctgcagctcctccacctgtgacaaaggcaagaggatgcgacagcgcatgctgaaagcacagctggacctcagcgtcccctgccctgacacccaggacttccagccctgcatgggccctggctgcagtgacgaagacggctccacctgcaccatgtccgagtggatcacctggtcgccctgcagcatctcctgcggcatgggcatgaggtcccgggagaggtatgtgaagcagttcccggaggacggctccgtgtgcacgctgcccactgaggaaacggagaagtgcacggtcaacgaggagtgctctcccagcagctgcctgatgaccgagtggggcgagtgggacgagtgcagcgccacctgcggcatgggcatgaagaagcggcaccgcatgatcaagatgaaccccgcagatggctccatgtgcaaagccgagacatcacaggcagagaagtgcatgatgccagagtgccacaccatcccatgcttgctgtccccatggtccgagtggagtgactgcagcgtgacctgcgggaagggcatgcgaacccgacagcggatgctcaagtctctggcagaacttggagactgcaatgaggatctggagcaggtggagaagtgcatgctccctgaatgccccattgactgtgagctcaccgagtggtcccagtggtcggaatgtaacaagtcatgtgggaaaggccacgtgattcgaacccggatgatccaaatggagcctcagtttggaggtgcaccctgcccagagactgtgcagcgaaaaaagtgccgcatccgaaaatgccttcgaaatccatccatccaaaagctacgctggagggaggcccgagagagccggcggagtgagcagctgaaggaagagtctgaaggggagcagttcccaggttgtaggatgcgcccatggacggcctggtcagaatgcaccaaactgtgcggaggtggaattcaggaacgttacatgactgtaaagaagagattcaaaagctcccagtttaccagctgcaaagacaagaaggagatcagagcatgcaatgttcatccttgttagcaagggtacgagttccccagggctgcactctagattccagagtcaccaatggctggattatttgcttgtttaagacaatttaaattgtgtacgctagttttcatttttgcagtgtggttcgcccagtagtcttgtggatgccagagacatcctttctgaatacttcttgatgggtacaggctgagtggggcgccctcacctccagccagcctcttcctgcagaggagtagtgtcagccaccttgtactaagctgaaacatgtccctctggagcttccacctggccagggaggacggagactttgacctactccacatggagaggcaaccatgtctggaagtgactatgcctgagtcccagggtgcggcaggtaggaaacattcacagatgaagacagcagattccccacattctcatctttggcctgttcaatgaaaccattgtttgcccatctcttcttagtggaactttaggtctcttttcaagtctcctcagtcatcaatagttcctggggaaaaacagagctggtagacttgaagaggagcattgatgttgggtggcttttgttctttcactgagaaattcggaatacatttgtctcacccctgatattggttcctgatgcccccccaacaaaaataaataaataaattatggctgctttatttaaatataaggtagctagtttttacacctgagataaataataagcttagagtgtatttttcccttgcttttgggggttcagaggagtatgtacaattcttctgggaagccagccttctgaactttttggtactaaatccttattggaaccaagacaaaggaagcaaaattggtctctttagagaccaatttgcctaaattttaaaatcttcctacacacatctagacgttcaagtttgcaaatcagtttttagcaagaaaacatttttgctatacaaacattttgctaagtctgcccaaagcccccccaatgcattccttcaacaaaatacaatctctgtactttaaagttattttagtcatgaaattttatatgcagagagaaaaagttaccgagacagaaaacaaatctaagggaaaggaatattatgggattaagctgagcaagcaattctggtggaaagtcaaacctgtcagtgctccacaccagggctgtggtcctcccagacatgcataggaatggccacaggtttacactgccttcccagcaattataagcacaccagattcagggagactgaccaccaagggatagtgtaaaaggacattttctcagttgggtccatcagcagtttttcttcctgcatttattgttgaaaactattgtttcatttcttcttttataggccttattactgcttaatccaaatgtgtaccattggtgagacacatacaatgctctgaatacactacgaatttgtattaaacacatcagaatatttccaaatacaacatagtatagtcctgaatatgtacttttaacacaagagagactattcaataaaaactcactgggtctttcatgtctttaagctaagtaagtgttcagaaggttcttttttatattgtcctccacctccatcattttcaataaaagatagggcttttgctcccttgttcttggagggaccattattacatctctgaactacctttgtatccaacatgttttaaatccttaaatgaattgctttctcccaaaaaaagcacaatataaagaaacacaagatttaattatttttctacttggggggaaaaaagtcctcatgtagaagcacccacttttgcaatgttgttctaagctatctatctaactctcagcccatgataaagttccttaagctggtgattcctaatcaaggacaagccaccctagtgtctcatgtttgtatttggtcccagttgggtacattttaaaatcctgattttggagacttaaaaccaggttaatggctaagaatgggtaacatgactcttgttggattgttattttttgtttgcaatggggaatttataagaagcatcaagtctctttcttaccaaagtcttgttaggtggtttatagttcttttggctaacaaatcattttggaaataaagattttttactacaaaaatgaaatttgtttggacttccacttgagacagtaaagagagtattagacacccagtaaaaactgccatataaagaagttgtaattgtttgttgtgtatgtatttttttcaatgccaaaccagctgtgatccaatttacatccacattttaggtccaacagcaagaagttcagagagagatttcccaaccagacattgggtcactcactggtcaccttgccagtgcattttattagaagggaatctgttgtagcaaatgggaataaacctgggtttctatagacccagaactgaaaaaataaaaaaaaaaaaaaaaaa

SEQ ID NO: 119 - DNA, 7291 bp, Homo sapiens; identical to SEQ ID NO: 110

SEQ ID NO: 120 - DNA, 3378 bp, Homo sapiens
acagctgcaccgccgagctgcgagcggctgcgagcgagagagcgtaagagcaagagagctagagagcgagcaacgggcactcgccccacgcctcccctcagccccaccgcgcgctccgcttgcctctccaccccgcccgactctacccggcccggtccctgcgcgggcacagcccagagctctggggcggtgcaggcagcctcgggactctccggcgcgccgccgcgtccccagacaaaggcttggccggcggccccggcccgctgcgccctcgctccccgcctccccagctcttctccgctcttcccccccgcgcttggctcggcgcgctccggccggccgcaaagtttcccgggcggcagcggcggctgcgcctcgcttcagcgatggccgcggagctgagcatggggccagagctgcccaccagcccgctggccatggagtatgtcaacgacttcgacctgctcaagttcgacgtgaagaaggagccactggggcgcgcggagcgtccgggcaggccctgcacacgcctgcagccagccggctcggtgtcctccacaccgctcagcactccgtgtagctccgtgccctcgtcgcccagcttcagcccgaccgaacagaagacacacctcgaggatctgtactggatggcgagcaactaccagcagatgaaccccgaggcgctcaacctgacgcccgaggacgcggtggaagcgctcatcggctcgcacccagtgccacagccgctgcaaagcttcgacagctttcgcggcgctcaccaccaccaccatcaccaccaccctcacccgcaccacgcgtacccgggcgccggcgtggcccacgacgagctgggcccgcacgctcacccgcaccatcaccatcatcaccaagcgtcgccgccgccgtccagcgccgctagcccggcgcaacagctgcccactagccaccccgggcccgggccgcacgcgacggcctcggcgacggcggcgggcggcaacggcagcgtggaggaccgcttctccgacgaccagctcgtgtccatgtccgtgcgcgagctgaaccgccacctgcggggcttcaccaaggacgaggtgatccgcctgaagcagaagcggcggaccctgaagaaccggggctacgcccagtcttgcaggtataaacgcgtccagcagaagcaccacctggagaatgagaagacgcagctcattcagcaggtggagcagcttaagcaggaggtgtcccggctggcccgcgagagagacgcctacaaggtcaagtgcgagaaactcgccaactccggcttcagggaggcgggctccaccagcgacagcccctcctctcccgagttctttctgtgagtcgtggccggtcctggcccccgcccttgccccggcccggactccctgtcccacgtccctagtcccagactaccccggaccctgtccctgccgcggccccagccttgacctgtttgacttgagcgagagggaggaagggcgcgcgggccgcgggcgacgggcgggtgcgcgggcgggcaggggaccttggctaaggcgagagtagcgcacgccagcgccgcctcctagactcgagcagagccggagagagagacgagagggtgggaggtcccggagtaacttctctccaggctgaagggcggcgaggcatagtcccgagaagtcaccaaggccatctggagactcctggctttctgaactttgcgcgttaagccgggacagctgctttgctgcccggagagtagtccgcgccaggaagagagcaacgaggaaaggagagggactctggcgtcccggcaggcgagaggcgaggctgagcgaaagaaggaaggacagacggacctgtctgtcagagttcggagaacactggctctcagccctgagacacaggcctcagttaggacgctcggcgcccaaatctcatcagttttattgcctgctcgattatatagaaaaatacaaaaaatctgcattaaaaatattaatcctgcatgctggacatgtatggtaataatttctattttgtaccattttcttgtttaactttagcatgttgttgatcatggatcatactccccttgtttctttgggtgagaagggatcgcagtttggaaactccggcggctgcgtgcggggtttcagtcccagctgtaggcttgtaaatacccgccccgccaaaccgcatagagaacgtggcagcaagctgagggtctttgtttgggtttattattacggtatttttgtttgtaagttaaaaagaaaaaaaaaaagaaaaagttccgggcattttgcatcagaaaacaactttgtcttggggcacacttggaagttgcatgttttctttccttcccttatccccattcggtcctctttttcctctctcgctttagttttcaaccttgttggtgctgagagagagaaccgagaggtcccagtacaagggcagggcagggcagggaagctgccaagctccgcaccccagaggagtgttctggactacagccttgtcttatggtcaaattgatacccttaataagaaaggaaaggaaaggaaaacagatcctcccctctgctttttattgtaaccagaatcaccctgaggtcccttctgaaccctctgggcctgcgctaattgtaggagccacagcgctcctagggtgagaggcttagccatccctgaccctggcagtgcactggtaagcagacactgcactgaaccaactgctatgctcagaatgtaccagaaacccaaacattggcaagtaattttgcaactttcaagtgcgttctttagaccaatgcattgcgtttctttccctgcttttgagatagtaggaagagttcttggtggtgtccccccccttcaattcttcagttgtatagtagttatagggaagatatgggtgtttttctttattattacttttttttttctgcaggtcagtaaaaggatttaagttgcactgacaaaaataccaaaataaaagtgtatttttaagttcccatttgaaattgctggcgctgctggccggatgcatttttgagtttgtattagttgataaattaacagtaataacaagattgtatgaaccgcatggtgcttgcagttttaaatattgtggatatttgtcctgcatcagaaacgagctttggtttttacagattcaactgtgttgaaatcaaacctgccgcaacagaaattgtttttatttcatgtaaaataagggatcaatttcaaaccctgcttatgatatgaaaatattaaaacctagtctattgtagttttattcagactggtttctgttttttggttattaaaatggtttcctattttgcttattaaaaaaaaaaaaaaaaaaaa

SEQ ID NO: 121 - DNA, 4761 bp, Homo sapiens
gccattttgtgcagtcgctgggaaggaaggagacgcctaaaccgcggcactgcccggtttgagcgtagccaaacctgcccaccggctttgtagccccgattctctgtgttttgctcccgtctccgacgagagaggcggcgacggtggcgtctgcgacgggagacagcgcgtcggagcgagagagcgctgcgcctgccgccgccccaacagcggaggcgccgccgccatcggtcgtcaccagaccggagccgcaggccctcccgagcccggccatccgtgccccgctcccagatctctatccttttgggaccatgcgcggaggaggctttggggaccgggaccgggatcgtgaccgtggaggatttggagcaagaggtggtggtggccttcccccgaagaaatttggtaatcctggggagcgtttgcgtaaaaaaaagtgggatttgagtgagctccccaagtttgagaaaaatttttatgtggaacatccggaagtagcaaggctgacaccatatgaggttgatgagctacgccgaaagaaggagattacagtgagggggggagatgtttgtcctaaacccgtgtttgccttccatcatgctaacttcccacaatatgtaatggatgtgttgatggatcagcactttacagaaccaactccaattcagtgccagggatttccgttggctcttagtggccgggatatggtgggcattgctcagactggctctgggaagacgttggcgtatctcctgcctgcaattgttcatattaaccaccagccatacttggaaaggggagatggcccaatctgtctagttctggctcctaccagagagcttgcccagcaagtacagcaggtggccgatgactatggcaaatgttctagattgaagagtacttgtatttatggaggtgctcctaaaggtccccagattcgagacttggaaagaggtgttgagatctgcatagccactcctggacgtctgatagatttcctggagtcaggaaagacaaatcttcgccgatgtacttaccttgtattggacgaagctgacagaatgcttgatatggggtttgaaccccagatccgtaaaattgttgaccaaatcaggcctgataggcagacactgatgtggagtgcaacctggccaaaagaagtaagacagcttgcagaggatttccttcgtgattacacccagatcaacgtaggcaatctggagttgagtgccaaccacaacatcctccagatagtggatgtctgcatggaaagtgaaaaagaccacaagttgatccaactaatggaagaaataatggctgaaaaggaaaacaaaacaataatatttgtggagacaaagagacgctgtgatgatctgactcgaaggatgcgcagagatggttggccagctatgtgtatccatggagacaagagtcaaccagaaagagattgggtacttaatgagttccgttctggaaaggcacccatccttattgctacagatgtagcctcccgtgggctagatgtggaagatgtcaagtttgtgatcaactatgactatccaaacagctcagaggattatgtgcaccgtattggccgaacagcccgtagcaccaacaagggtaccgcctataccttcttcaccccagggaacctaaaacaggccagagagcttatcaaagtgctggaagaggccaatcaggctatcaatccaaaactgatgcagcttgtggaccacagaggaggcggcggaggcgggggtggtcgttctcgttaccggaccacttcttcagccaacaatcccaatctgatgtatcaggatgagtgtgaccgaaggcttcgaggagtcaaggatggtggccggagagactctgcaagctatcgggatcgtagtgaaaccgatagagctggttatgctaatggcagtggctatggaagtccaaattctgcctttggagcacaagcaggccaatacacctatggtcaaggcacctatggggcagctgcttatggcaccagtagctatacagctcaagaatatggtgctggcacttatggagctagtagcaccacctcaactgggagaagttcacagagctctagccagcagtttagtgggataggccggtctgggcagcagccacagccactgatgtcacaacagtttgcacagcctccgggagctaccaatatgataggttacatggggcagactgcctaccaataccctcctcctcctccccctcctcctccttcacgtaaatgaaaccactcaagtggtagtgactccagcagacttaattacattttaaggaacactgtctttcctttttttttcctcttcgccttttctttttttttccttttttctttttttttttttaatttttccccccaaccatcgtgatttgtcttttcatgcagattagttagaattcactgccaggtttcttctgcccaccaaaatgatccagtctggaataacattttgtaaaaaaaaaaaaaatatatatatatatatatagctgactggaagagattaatttcttcccccaacttcttgcatgttgaagatatttgagctatttttcatctaaaagagtaaggtattaggcccttttgtgggagccccatgttttgtttttctgagttggtggggagggagggagggggagggctgaattgttttgcagaggaagatggcatctgtgctttaaatttctcattactgggttagaaaacaaagagggagtgccctgcacattttcttttgtgcttttaaatgtttcttaagttggaacaggtttcctcgggcctgttttgactgattgctggagtgcatttgatagttaaaaattactaattggttttatttcccttcacactctgcctccccacttctccccccgttactgaaaaataaccattttagtgtcaggctagaaattgaattgctgagttttgtgtatcctttaaattaaaaaccacaagtgtttattgtagtggttaaactgtagcatctcagcatctgggtggaagctgcctatatttcttcccagtttaactggggaccatctgtgaaattaattttccatccagacagctgctgtgagcaaatgaacataaatgctcgctggaaatttactaaccagtttttatattgacctgcagtgtaaaaagcacatttaattataaacaatatattcaaaatgggcaaattttattttcaaatgcagtgtagagctagattaaaagcaactctttgccacctactctgcccttttggcaaagttaccttgaacaaagaatcttaagggtttattaagaactctttattttcttcataccctgttctctgcagtgctttctaacagcttctgggtgcagattttcttcggcatccttttgcactcagcttattacaggtaggtagtgcttaagaaaagtcatggaggactaaagcctaagtccttttcacttttcctccatctgaaggtaggtgagttcatcctcttcatagtaatgctgttttaccaagactttatagcagatggacccagaaagaattttctgctattgtgttcactacaacaggatagggacatcagacagccccagaaaccccttccagatctgatatgggactattaatttttatgctgttaattggtattcattcacaatgcagttgaagggggaaggctccactgcattctttggctaaggcctgaatgcttgctcatctgtaagatctatactcgaggttttgttttccttttaaaattctttagggagagagggatggtttctgaggggttctgaaagtatgattcaatgtgcaacatacaggtaggtcttcagcataagctgaaatatatgcatgtaaaaactttgacatctttttttttaattttccactttcttcttaactttacttctctttttgtcccccccccatcttacagaagttgaggccaagggagaatggtaggcacagaagaaacatggcaaactgctctgtgctttcaaaccaaagtgttccccccaaccccaaatttgtctaagcactggccagtctgttgtgggcattgttttctacaaccaaattctgggtttttttcttctttctttaaacatagaggtaccaccacaagggatgccctactctctcgcagctcttgaaagcatctgtttgagggaaaggtctctgggcaagcaagtggttatttggattgcttgcttccctttttccacctgggacattgtaatcataaaataacagtaaattccaaacctcaaaaactattatggcctgagcacagctgaaatctagcagagtttaactcttctgcctccatgtctgtcacttataattcaggttctgctgttggcttcagaacatgagcagaagaatcgttttatgctagttattgcattcatggttgaaactcaacttagggaaagggttccaatgtattaagcaatgggctgcttctccccaatcctccctaacaattcgttgtgtggacttctcatctaaaaggttagtggcttttgcttgggatcagtgctctctattgatgttcttgctggtctccagacacattcctgttgcattaagacttgaaagacttgtagatgtgtgatgttcaggcacaggatgctgaaagctatgttactattcttagtttgtaaattgtccttttgataccatcatcttgttttctttttgtaggtataaataaaaacactgttgacaataa

SEQ ID NO: 122 - DNA, 5913 bp, Homo sapiens
gtggacgcagcgggctttggaaaggccccaagttaatgaggcgtgcgccggctgccgagcgcctcttggagctgggctttcccccgcggtgcgggcgccaggagccgccttttccgctgggtgtcactcgggggtggggaagatggcccattcaaaagcgccgcgagggggcccggccagtgcccttcagtgagcgctcgcaagaggacggcagaggcccggcagctcggagctccgggaccttgtggcgcatcaggacgcggctgtccctctgccgggacccagagccgccgccgccgctctgcctcctgcgtgttagcctcctctgcgcgctccgggcaggcggccgtgggagccgctggggcgaggacggcgcgaggctgctgctgctgcccccggcccgcgcggctggaaacggagaggccgagccaagcggcggcccctcttatgctgggaggatgctggagagtagcggctgcaaagcgctgaaggagggcgtgctggagaagcgcagcgacgggttgttgcagctctggaagaaaaagtgttgcatcctcaccgaggaagggctgctgcttatcccgcccaagcagctgcaacaccagcagcagcagcagcaacagcagcagcagcagcagcaacaacagcccgggcaggggccggccgagccgtcccaacccagtggccccgctgtcgccagcctcgagccgccggtcaagctcaaggaactgcacttctccaacatgaagaccgtggactgtgtggagcgcaagggcaagtacatgtacttcactgtggtgatggcagagggcaaggagatcgactttcggtgcccgcaagaccagggctggaacgccgagatcacgctgcagatggtgcagtacaagaatcgtcaggccatcctggcggtcaaatccacgcggcagaagcagcagcacctggtccagcagcagcccccctcgcagccgcagccgcagccgcagctccagccccaaccccagcctcagcctcagccgcaaccccagccccaatcacaaccccagcctcagccccaacccaagcctcagccccagcagctccacccgtatccgcatccacatccacatccacactctcatcctcactcgcacccacaccctcacccgcacccgcatccgcaccaaataccgcacccacacccacagccgcactcgcagccgcacgggcaccggcttctccgcagcacctccaactctgcctgaaaggggcagctcccgggcaagacaaggttttgaggacttgaggaagtgggacgagcacatttctattgtcttcacttggatcaaaagcaaaacagtctctccgccccgcaccagatcaagtagtttggacatcaccctactgaaaacttgcgattcttcttagttttctgcatacttttcatcacgatgcaggaaacgatttcgagtcaagaagacttttatttatgaacctttgaaaggatcgtcttgtatggtgaattttctaggagcgatgatgtactgtaattttattttaatgtattttgatttatgattatttattagtttttttttaaatgcttgttctaagacatttctgaatgtagaccattttccaaaaaggaaactttattttcaaaaacctaatccgtagtaattcctaatcttggagaataaaaaagggcggtggaggggaaaacattaagaatttattcattatttctcgagtactttcagaaagtctgacactttcattgttgtgccagctggttgaaattaaaactctgatattactttttttgaggatttttatttttgtttttgcttaaacatatagtttgtctagaagtttaaaaagctaaaagttaaaaatggtgtaattatgaaaatctaacactcaagatagtttctaaaaggaaatcagtagttaaggatacctgatttcaaaatatttaaagcataacctaactgatggtaggatgattgtatcttgaatatgtggtagggccacatctattgtaggaaaaccttgcttttatcatctgtgtgtaaagggcttaataaggagaagaggccttttgactgatttgtgagtataaatgcatttgctgtttcatttcaaaaatgttgtggaggaaaagagtacatttaacttgtataagagaatatttgtactcctgtccaggctgcaggacctttcttcgagagctttgcacacttgacttgaaccacattttctgatccctttactttgttttagaagcacactgaaaaatctcgttgtttaaagtacaatttgtaaatatttcaaaggtctaggagtcataacttttgttttcatactgaaaatgatgttgatcagagaaaccaactgttttgcttttcattgctctgtgagaaatttgaggattctgttttgctgttaggtaagctaaactcagaaattgaaaaggaaaagactggataaacacaggattttcagtaagaaaacaaccccagtcttgtcttagaagccacttgttgaggagtctgttgggggaaaaaagaggatatgcttttaaaggtagaacaaaccttcttctgtgttaaatcaaaaggatgttcaaaatccaccaggacagatgctacttgggtttaaatggagccatagatgatacaaagtcctcttggggctgaaaatcacttcctatttgcatggctttactaactggtttctgttttccattatctttttcacagaaagtcttggtcagtatttttccagcatttaaattgaaacggtcagtattagaccactgctaggttatgtagtcaagaaataaaaatagaattacatgctacagatgtctttattctccttccatctagaaaggagttccaaggtcaaattactttttagtgcaatagttaaatgacattttgagatcataactcatatccaaaaagttgcagggaaaattaaaatagctttcccctattaagctaatggcaaacaaaacttaagtggacccccacttccagtggttgtttaggttgcagttgtgaaaatatgctgccaacatttaaaaacttgtttcatatgtatatatgtatacacatatatgaatatgtatgtatatatacatatatgagaacatgtgtgtacacatatatgaatatgtatatatgtgtatgtatgtatatatgtatatgaaatgagagccacatctaaagatttcttaaatcaagtttggttcagcttccttagaactgtggctgtactttttgaggagtacctcatagtactatatttttaatgcatgcaaatcataatagctccaaatgaaccacagttttttcccaatggaggatttttttttaattcttgtactaaaaaaaaaaaatccataccaaatatttttacaaattaagattgatgtaggttttaaaaaaggcatttgtatgttgttagcttacatatggggctaggtaatttcattgcttaaaaagatgcgcctaggctccctcttggtggctggatttctttttcttcgcccgtggtggccatggttcttaatagggccaccggaatcatggtttctttttttttttttttttttgagatggagtctcgccctgtgacccaggctggagtgcagtggcacgatctcggctcactgcaacctctgcctcctgggttcacgccattctcctgtctcagcctcctgagtagctgggactacaggtgaatgccaccacgcccggctgatttttgtatttttagtagagatggggtttcaccatagtggtcaggctgttctcgaactcctgacctcaggtgatccacctgccttggcctcccaaagtgctaggattacaggtgtgagccaccacacccggccccagaataatggtttcttgactttctgtagcccttgttccttagtctgctgtgatatttatgttgacctttatcattttctattctgaacccctcttagcatttaatgtgaaatctaagaaattagaagtagaatggcttttattgttttgacacctttgaaattattattaataatttttccagagcaaaaaagcaaacacgctcaataagactaaacaaaacaaaatataaatgtacatcatttaatgtcccagtggctctattctacctgtaagaaaatgatacaaaaccacctaagatattttgaagcctgacaaatcagcttcatggaaaaaggtaaaaaatgcatttttcaaccgaaagggcagatccaatagaagacccgctccttaaataaacataaaatgtaaaaagttggaaaattaagagtaatgttccatctggaaactgaacttttgtccttgaacttgtgttggcaccaagcctcatacacagtgagctcaataactgttgggacaaaggaaggaaggacaaaatgtgtaacttcccagcatctgggagatgctgtctcttgcctcactgagtgttccttttctttgctctcatgtcattccctgagaacaatgaattctgggacaggctaaacatcatgatgaagtttcttaaacagactttcttagtggaaatccatttagatctgggtgtgctctatggggagtgctgacgtcaaagagcaaatgtctataaggggcccttttaaaatgaacattttcctcattgagcaagctgggattctctaatgtagaaatcaagccatctttataatttcacttcagatgtttatgtttttgttttttttgtctccaatgatggtaaaaataaaaactacgcattacttaaaggagtttccctcacatgtaaacactgttaggaagtctggattaagttgaaagtcctgttttaactttttttctctcatataccaaacactctgtatttctcttaaagaagccctttaagagaaagccctaattttatatctgacagtaaagtttgctgcaagtgtatgagttcaaacacatcccttgttttctgtccctaggggaaaagtcatgtagttttagcttggctccagtgttaatattatattcagtagcagccttagaagagtggtctaagacttgaacctggagcaattttatagcacagaatcctacgaagataggactgtgaacatttgttttctttttcgtgtgtgtcaaactaactggtttttgctttaccaataaaatgtcctcggcagagtaaattttaaacgtgaaaattatagatcttgatattgaatccatcagtgattcaagagatacacctatttgcctaaaacaacctaagatgtattggttatggaatcatgtgttggataggttcttaagacctgtttcctcaaatcttgacacagttttcaagggtggcttattgacttgcacggttgggcagataatccagatttacctaagattgggtaaaaaagtcatctgtgactttgctggcagggcatttgctaagtggagtacaggatctaaaagggttttcttagaaagggcaatattgtccaatgaagtaagcagaaggactctgggttagaagcatctgcacaaaaactggtgagacctactctccactgctctgcagctggatggctgatggcaggctgagcagtggggaagcaggttttaacaacagggagtccttccaggtcactgtatattgagaagaaacataaaactattgtctgttacattccgaggtcagccttcttcttaacgttttataatatgcaaatgccagcttctggaaagcaagtatcatcatgtaccaaatgctttatacaccatcacattcatgaattttttagcatggtcagaacttgtgtaaatatgtctcttagatgattttggggagatgtgatttatttttcatattttcaaaatgcatttcatttcaaataaagttatctattgagacaaccga

SEQ ID NO: 123 - DNA, 4071 bp, Homo sapiens
gagtccagccgctggtgcgcggagcggttcaccgtcttcggagcggttcggcccagcctttcgcccaggcgcccaggcccgctgcgcgcgtgcgtgagcgcgcctgcgccgccagggccgctgcaaggggaggagagcggccgcctcaggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataacctggtgcttcatgccccacctccaaccaagatcaaacgggagctgcacagcccctcctctgagctgtcgtcttgtagccatgagcaggctcttggtgctaactatggagaaaagtgcctctacaactattgtgcctatgataggaagcctccctctgggttcaagccattaacccctcctacaacccccctctcacccacccatcagaatcccctatttcccccacctcaggcaactctgcccacctcagggcatgcccctgcagctggcccagttcaaggtgtgggccccgcccccgccccccattcgcttccagagcctggaccacagcagcaaacatttgcggtcccccgaccaccacatcagcccctgcagatgccaaagatgatgcctgaaaaccagtatccatcagaacagagatttcagagacaactgtctgaaccctgccaccccttccctcctcagccaggagttcctggagataatcgccccagttaccatcggcaaatgtcagaacctattgtccctgcagctcccccgccccctcagggattcaaacaagaataccatgacccactctatgaacatggggtcccgggcatgccagggcccccagcacacgggttccagtcaccaatgggaatcaagcaggagcctcgggattactgcgtcgattcagaagtgcctaactgccagtcatcctacatgagagggggttatttctccagcagccatgaaggtttttcatatgaaaaagatccccgattatactttgacgacacttgtgttgtgcctgagagactggaaggcaaagtcaaacaggagcctaccatgtatcgagaggggcccccttaccagaggcgaggttcccttcagctgtggcagttcctggtcacccttcttgatgacccagccaatgcccacttcattgcctggacaggtcgaggcatggagttcaagctgatagaaccggaagaggttgctcggcgctggggcatccagaagaaccggccagccatgaactatgacaagctgagccgctctctccgctattactatgaaaagggcatcatgcagaaggtggctggagagcgatacgtctacaaatttgtctgtgacccagatgccctcttctccatggctttcccggataaccagcgtccgttcctgaaggcagagtccgagtgccacctcagcgaggaggacaccctgccgctgacccactttgaagacagccccgcttacctcctggacatggaccgctgcagcagcctcccctatgccgaaggctttgcttactaagtttctgagtggcggagtggccaaaccctagagctagcagttcccattcaggcaaacaagggcagtggttttgtttgtgtttttggttgttcctaaagcttgccctttgagtattatctggagaacccaagctgtctctggattggcacccttaaagacagatacattggctggggagtgggaacagggaggggcagaaaaccaccaaaaggccagtgcctcaactcttgattctgatgaggtttctgggaagagatcaaaatggagtctccttaccatggacaatacatgcaaagcaatatcttgttcaggttagtacccgcaaaacgggacatgatgtgacaatctcgatcgatcatggactactaaatggcctttacatagaagggctctgatttgcacaatttgttgaaaaatcacaaacccatagaaaagtgagtaggctaagttggggaggctcaaaccattaagggttaaaaatacatcttaaacattggaaagctcttctagctgaatctgaaatattaccccttgtctagaaaaaggggggcagtcagaacagctgttccccactccgtgttctcaaaatcataaaccatggctactcttgggaaccacccggccatgtggtcgccaagtagagcaagccccctttctcttcccaatcacgtggctgagtgtggatgacttttattttaggagaagggcgattaacacttttgacagtattttgttttgccctgatttgggggattgttttgttttggtggttgttttggaaaaacagtttataaactgatttttgtagttttggtatttaaagcaaaaaaacgaaaaacaaaaaacaaaaacaaaccttttggtaatgtgcactgtgtctttagccagggccgtgcaacttatgaagacactgcagcttgagaggggctttgctgaggcttccccttggccatgtgaaagcccgccttgttgcctgctttgtgctttctgcaccagacaacctgatggaacatttgcacctgagttgtacatttttgaagtgtgcagggcagcctggacacaagcttagattctctatgtatagttccccgtgttcactaacatgccctctctggaaagcatatgtatataacatgtgtcatgtcctttggaaacctggtcacctggtgaaaacccttgggattcttccctgggcatgactgatgacaatttccatttcatcagtttgttttgttttcctttttctttaaatcttggactttaaaccctacctgtgtgattcagtagggtttgagacttagctgtgatactgacaggtaagcaacagtgctagcattctagattcctgcctttttttaaaaagaaattattctcattgctgtattatattggaaaagttttaaacaaccaagctaaagctatgtgaaagttgagctcaaagtagaggaaaagttactggtggtaccttgctgcctgctctgctggtagaattctgtgctccccgtgacacttagtacattaagaatgactacactgttcctcgtatgtgaaggaggcagtgctgactccgtgagtgtgagacacgtgctttgaactgcttttctattcatggagcactccatagtctcaaactgtcccccttatgaccaacagcacatttgtgaagaggttcgcagggataaggggtgcactttatagctatggaaacatgagattctcctctattggaagctaattagcccacaaaggtggtaaacctgtagattgggccttaattagcattgtactctaatcaaaggactctttctaaaccatatttatagctttcttaacctacacatagtctatacatagatgcatattttacccccagctggctagagatttatttgttgtaaatgctgtatagatttggttttcctttctttacttaccctggtttggattttttttttttttttttttgaatggatttatgctgtcttagcaatatgacaataatcctctgtagcttgagctacccctcccctgctgtaacttacgtgacctgtgctgtcactgggcataggacagcggcatcacggttgcattcccattggactcatgcacctcccggatggtttttgtttttttcgggggttctttggggtttgtttgtttgcttcttttccagagtgtggaaagtctacagtgcagaaaggcttgaacctgccagctgatttgaaatactttcaccctgcgcagggccgtatgcatcctgccaagctgcgttatattctgtactgtgtacaataaagaagtttgcttttcgttta

SEQ ID NO: 124 - DNA, 3404 bp, Homo sapiens
gcagttcagacccccccacacccatcaaagagccgctcctcccccccgcaggcgccttcgccgcctccctcccttcctttcctttccgctcctcttccgacctgtccacccgggaggaagggagctggaaagggggcggaaacctctcccctccaaaaagcacaacaaaactgttcagtgcggaggagccgggttcgcccctgccggacagcggggggctttgttccccgcagttgtttcctgcccatttgacctgtcagctgctggggaaacgctgctgttgacctttggttgaactgctaaggcgattttgctgatttttctttctttttccgcgagggctgtcttttgctcctccaaatgagcccagtccccctcccttctccccaaagcgctccaagagaaagtgccaggaaggggcttgtcccggaaggcctggcggctgagcggggccaggtcctggttaggccaccagggtgggcgtccgcgccattgtttgagcttgtcggcgctggtgggagagatgagggcaattcctctgggacgcaagtcccctcgaatggccggggctggccgggatgttccccgcacggcgctgccctcgagtccccccgatggagagcgcgggcgcgccttccttcgctggcgtccaaacccgggaccagctagaacacagcagggctgggactgggttccagccccacgtggagtctggatttgttttgttgtgttttgctttccttcctggaagaaatcccgaggggaccgccctagagcggcagctccaggacctcggcccttgggcttccgggggtgcagccacttaggccccgctcccggggagagagggattattttttaagatttatccccagggcgcgcggcatttccctgtccctcgtgaatcccgttgagagtcctccctccccaacctcctccatttccccagccagaccgattcgagagccctggagattctgggcgaggctagtgactgggtagtacaggcctctagccccaccattgctctctctgtcttcagttccccaggagggcaatggcatcaaacagcacagctctgggggatgtcaatattgcataccttttctacctaaagggaaaatgactcgcttttctgcttgcaaatatggtagtttctgcttacaaatgtaatacaatgcccatgacagccaaggactggaagcataagttgctaggtcttacaggtgattttttacaatgaagcaaactcactatgttagacaccatttacattggatgtctccaactaacaaaagtaactaaagacagatgtaggtgtaaattgagagtgaaatttgaccctttagaccgtcacaacttccttgggcttatcctgggtgcttataggagaggtgggctccacccacaaaaatggactgctcagaaaaatgagggagagagaaagggtggccactttcccgagccaagaaattccttgaaaaaaaatcagaacatctgaaaccagagagccgatttccttaccgggaggcagttcctggctaacgaagaggaagcacgatgggaagaaaagttcactccaacggaagccagtttgctgaacatagcagatcgcccaggaggactgggagagactgcaaaccagttcgagcccccagcatggcgttaggtgtcagccagctggcaggaaggtccaggtgtctgtgttcagagtctcaaggcggctatgagaggttttcctccgagtacccagaattctgttctaaaaccaaggccctggcagccatcccacccccggttccccccagtgccacagagcccttggacctgggctgcagctcctgtgggaccccactacacgaccaggggggtcctgtggagatccttcccttcctctacctcggcagtgcctaccatgctgcccggagagacatgctggacgccctgggcatcacggctctgttgaatgtctcctcggactgcccaaaccactttgaaggacactatcagtacaagtgcatcccagtggaagataaccacaaggccgacatcagctcctggttcatggaagccatagagtacatcgatgccgtgaaggactgccgtgggcgcgtgctggtgcactgccaggcgggcatctcgcggtcggccaccatctgcctggcctacctgatgatgaagaaacgggtgaggctggaggaggccttcgagttcgttaagcagcgccgcagcatcatctcgcccaacttcagcttcatggggcagctgctgcagttcgagtcccaggtgctggccacgtcctgtgctgcggaggctgctagcccctcgggacccctgcgggagcggggcaagacccccgccacccccacctcgcagttcgtcttcagctttccggtctccgtgggcgtgcactcggcccccagcagcctgccctacctgcacagccccatcaccacctctcccagctgttagagccgccctgggggccccagaaccagagctggctcccagcaagggtaggacgggccgcatgcgggcagaaagttgggactgagcagctgggagcaggcgaccgagctccttccccatcatttctccttggccaacgacgaggccagccagaatggcaataaggactccgaatacataataaaagcaaacagaacactccaacttagagcaataacggctgccgcagcagccagggaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggaagggagggcaaagggatgagaagacaagtttcccagaagtgcctggttctgtgtacttgtccctttgttgtcgttgttgtagttaaaggaatttcattttttaaaagaaatcttcgaaggtgtggttttcatttctcagtcaccaacagatgaataattatgcttaataataaagtatttattaagactttcttcagagtatgaaagtacaaaaagtctagttacagtggatttagaatatatttatgttgatgtcaaacagctgagcaccgtagcatgcagatgtcaaggcagttaggaagtaaatggtgtcttgtagatatgtgcaaggtagcatgatgagcaacttgagtttgttgccactgagaagcaggcgggttgggtgggaggaggaagaaagggaagaattaggtttgaattgctttttaaaaaaaaaagaaaagaaaaagacagcatctcactatgttgccaaggctcatcttgagaagcaggcgggttgggtgggaggaggaagaaagggaagaattaggtttgaattgcttttttaaaaaaaaa

SEQ ID NO: 125 - DNA, 2498 bp, Homo sapiens
gctgagcgccggaggagcgtaggcagggcagcgctggcgccagtggcgacaggagccgcgcgaccggcaaaaatacacgggaggccgtcgccgaaaagagtccgcggtcctctctcgtaaacacactctcctccaccggcgcctccccctccgctctgcgcgccgcccggctgggcgcccgaggccgctccgactgctatgtgaccgcgaggctgcgggaggaaggggacagggaagaagaggctctcccgcgggagcccttgaggaccaagtttgcggccacttctgcaggcgtcccttcttagctctcgcccgcccctttctgcagcctaggcggcccgggttctcttctcttcctcgcgcgcccagccgcctcggttcccggcgaccatggtgacgatggaggagctgcgggagatggactgcagtgtgctcaaaaggctgatgaaccgggacgagaatggcggcggcgcgggcggcagcggcagccacggcaccctggggctgccgagcggcggcaagtgcctgctgctggactgcagaccgttcctggcgcacagcgcgggctacatcctaggttcggtcaacgtgcgctgtaacaccatcgtgcggcggcgggctaagggctccgtgagcctggagcagatcctgcccgccgaggaggaggtacgcgcccgcttgcgctccggcctctactcggcggtcatcgtctacgacgagcgcagcccgcgcgccgagagcctccgcgaggacagcaccgtgtcgctggtggtgcaggcgctgcgccgcaacgccgagcgcaccgacatctgcctgctcaaaggcggctatgagaggttttcctccgagtacccagaattctgttctaaaaccaaggccctggcagccatcccacccccggttccccccagtgccacagagcccttggacctgggctgcagctcctgtgggaccccactacacgaccaggggggtcctgtggagatccttcccttcctctacctcggcagtgcctaccatgctgcccggagagacatgctggacgccctgggcatcacggctctgttgaatgtctcctcggactgcccaaaccactttgaaggacactatcagtacaagtgcatcccagtggaagataaccacaaggccgacatcagctcctggttcatggaagccatagagtacatcgatgccgtgaaggactgccgtgggcgcgtgctggtgcactgccaggcgggcatctcgcggtcggccaccatctgcctggcctacctgatgatgaagaaacgggtgaggctggaggaggccttcgagttcgttaagcagcgccgcagcatcatctcgcccaacttcagcttcatggggcagctgctgcagttcgagtcccaggtgctggccacgtcctgtgctgcggaggctgctagcccctcgggacccctgcgggagcggggcaagacccccgccacccccacctcgcagttcgtcttcagctttccggtctccgtgggcgtgcactcggcccccagcagcctgccctacctgcacagccccatcaccacctctcccagctgttagagccgccctgggggccccagaaccagagctggctcccagcaagggtaggacgggccgcatgcgggcagaaagttgggactgagcagctgggagcaggcgaccgagctccttccccatcatttctccttggccaacgacgaggccagccagaatggcaataaggactccgaatacataataaaagcaaacagaacactccaacttagagcaataacggctgccgcagcagccagggaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggaagggagggcaaagggatgagaagacaagtttcccagaagtgcctggttctgtgtacttgtccctttgttgtcgttgttgtagttaaaggaatttcattttttaaaagaaatcttcgaaggtgtggttttcatttctcagtcaccaacagatgaataattatgcttaataataaagtatttattaagactttcttcagagtatgaaagtacaaaaagtctagttacagtggatttagaatatatttatgttgatgtcaaacagctgagcaccgtagcatgcagatgtcaaggcagttaggaagtaaatggtgtcttgtagatatgtgcaaggtagcatgatgagcaacttgagtttgttgccactgagaagcaggcgggttgggtgggaggaggaagaaagggaagaattaggtttgaattgctttttaaaaaaaaaagaaaagaaaaagacagcatctcactatgttgccaaggctcatcttgagaagcaggcgggttgggtgggaggaggaagaaagggaagaattaggtttgaattgctttttt

SEQ ID NO: 126 - DNA, 5249 bp, Homo sapiens
cttccctccccgactgtgcgccgcggctggctcgggttcccgggccgacatgggcgccgccgcgtgggcacggccgctgagcgtgtctttcctgctgctgcttctgccgctcccggggatgcctgcgggctcctgggacccggccggttacctgctctactgcccctgcatggggcgctttgggaaccaggccgatcacttcttgggctctctggcatttgcaaagctgctaaaccgtaccttggctgtccctccttggattgagtaccagcatcacaagcctcctttcaccaacctccatgtgtcctaccagaagtacttcaagctggagcccctccaggcttaccatcgggtcatcagcttggaggatttcatggagaagctggcacccacccactggccccctgagaagcgggtggcatactgctttgaggtggcagcccagcgaagcccagataagaagacgtgccccatgaaggaaggaaacccctttggcccattctgggatcagtttcatgtgagtttcaacaagtcggagctttttacaggcatttccttcagtgcttcctacagagaacaatggagccagagattttctccaaaggaacatccggtgcttgccctgccaggagccccagcccagttccccgtcctagaggaacacaggccactacagaagtacatggtatggtcagacgaaatggtgaagacgggagaggcccagattcatgcccaccttgtccggccctatgtgggcattcatctgcgcattggctctgactggaagaacgcctgtgccatgctgaaggacgggactgcaggctcgcacttcatggcctctccgcagtgtgtgggctacagccgcagcacagcggcccccctcacgatgactatgtgcctgcctgacctgaaggagatccagagggctgtgaagctctgggtgaggtcgctggatgcccagtcggtctacgttgctactgattccgagagttatgtgcctgagctccaacagctcttcaaagggaaggtgaaggtggtgagcctgaagcctgaggtggcccaggtcgacctgtacatcctcggccaagccgaccactttattggcaactgtgtctcctccttcactgcctttgtgaagcgggagcgggacctccaggggaggccgtcttctttcttcggcatggacaggccccctaagctgcgggacgagttctgattctggccggagcaccagaccctctgatcctggagggaccagagtctgagctggtccttccagccaggcctggcagccagaggtgctccgggattgcaaactcctcttctcacctgccaaagatggagaagagtgccagggacccctcaaggagggagacgctccatatcccagggcataggacttgcaggttcctaggagcaggagcatctcccatcgcacgtgctttctgctcttctgggaatttctcacactggcaaagcagtccagcctccgtcttctggtccactctgctctgagcagcctgggatgctgaactcttcagagagatttttttatagagagatttctataattttgatacaaggtcatgactatcctagaactctctgtggtttttgaaaatcattgaattctattaatgtaggtacctaaagtgaccttaactgaatgtggatgaggctggggctggtgtgggtcttttggctgcttttcaaggtgtcccccaatgtggccctcaagagccatccccactgcctggccagagccattgttgtcccctacttcctaggccatttctggggcttgggggatgaatgctgtcctgtgctgtaaacactatgcaaatggaagttatcggttgtggtgctgtgcagcgctctgtgggcgactaagtgccactcacgcagcatgttcctggcaaggagcacataccatcaagccacactatcatggtattgttctcacagtcttttggtggttgatggccactgcaaacctggcaccatcagatctcttctgatctcttgccccagtggggcctggttggtagaatgttggcattcggttgatatccaaagcctgttctcccagccgtcctcctgcagctggagccttcaggccgtattctcacgagggaacgtttgccaaggctctgacctcacagaagatgcccagggcccagaagccatcagaattatcagtggagaagcaccttttgactcttcccttccaatgtaatctctgccaacaccatgaggcttaaggtgctctaagtcatgagtgttttggtctcaaatgctgcagttttaataatctgtgactcctgagagcccatggttttttgaccttgtggttctaaaattccttgtctgacccctgtagatcttttccttgccatgtcacctcccttggcctttgatcctggaaaggtggcagagcctccactgagccaggcccagagctccttgcagtgccttcttccttgtttacctgtgggaggaaacactttttttgtcaggggcagcctggttcagagctcagaggtcacactgtatcaaagatctcaaacagcaaagtcagcatttgctgtatagagctgccacccaactctaagcaggagaaactgtacagaaagggctttgctatttttcccttttgggaaaacaatgaagtgttttaagtcctgggtggactgagagatggtttgcctgtccagacttgctctcaagcctcatccagagaaggagctgcagatgagggagcccgtacactccctgccaccactaggttgtaagcctgtagctggctggctgatttcattttggaattcatttgccatccacagccttacactaggcacacactttagagtctggggctccagtggggcccgcctaattttttttccccccaagacagggccttgctctgtctcccaggctggagtgcagtggcatgatcatggcttactgcagccttgatctcccaggctcaagcgatccttctgcctcagcctctctggtagctgagactgcatgcccagctccaaatcaccttgattcatatcagcagtaataatcacttgtgttctgaaagaaagggcaccagaagttctagcaaaattcagttgtgttctgtgagctagcactttttcctctgacccaattttcttacctataaaatggtgataaaaaccgacaggttgttcaaaggcccagatcagctaaagcatgtatataagagcacgttgtaaacttgaaagagacaaaggcacaaatgtggctgttgattaatttgactgcttctcgttgctcgtcacctccatgccaggcactgtgcttgctaattgctttatgggggcattctcttatttattccccagccctgggaaataggagctgtcattatccttctctttctgcacaaggaaaaattaatgccctgagaattgtcataattttcccaaggctgcccagctggtggtgttaagccagaatttgacctcccagagccagtttccattagctgccatgctctgctgcctctaattcacagaatgcactttctaccctgtgtgccatggagacctcctatggaaaaatgatcagccaccttaccttctactgggtacctgctgtgagtctgcctatgccagaaggattaaggaggggaggttacccaagaaacaaagcctacatgccgcttacagcccccgttggatggttgctcagtacaacagtcttgcattcagcaggtgtttgttcatcacctactatgtgtcaggctctatgctaggtactggggatacaggagagaatcaagcgtaaagtctttgttctcaaggaatttgcattctagaaagtagaagatgtaataaatgtactgtgggacatgttaataagtgctataaagaaatataaagggtttgggagcaaaaagagggagtggatctattttagatgagcccaggtaagacctctctgaagagctgtcatgaaggagggagggagcacattcctggcagagaaaacagcacgtgcaaaggccccgagactggagtgtgttcctgaagagcagccaggaggccagcatggctggagaggcaggcataggcagggaaccgagcagcaggtcagagcaggcgagctgacattctgcagcctggacggccatggcaggaagcttttagttggagagatacaggaagcctcctagggttctgagcagaagaggggcatgagctgattcacattctgaaggacctctctagctggccagtgctgaggaggttggagagagaaagggtgaaagcagagagaccagtgcagggctgttaacagggttgcaggcgagagactggggtgctgggctcccctagactaggactccagtgccctcctctcccaagagacaaaggccattgcattgaaggaggtgggaaatgattagattctgaacatatgtaattatttttcagtctttttcaaagatacaaatatttacatagttttaatcatgtaatatatacaatttaatgtcctagtgttttacttaatagtgtatcatgttttccctgttggtatgtagcctggataaatgctcttaattataaaaaattctgtcgaggagtgttccatagtttattgttttcctattatgagaatttaggccaagtgtggtggctcatgcctgtaatcccagcactttgcgaggccgaggtgggcagatcacttgaggtgaggagttcaagaccagcctggccaacatggtgaattatctctactaaaaatacaaaaaaataataataatagccaggcgtggtggcacatgcctgtattcccagctgcttgggaggctgaggcaggagaatggcttgaacctgggaggtggaggttgcagtgagccgagatggtgccactgcattccagcctgggcaacagagcgagactccatctcaaaaaaaaggagacttcatgtgcccccaatttttcactattgttatttgaaaaaatatttttatttgtaagagtttttctttatttaaaatgttcattaataaagttgttggacgggaagcaaaaaaaaaaagttgtttaagataaattcccagaagtgaatttgttagatcaaacacttaaaactttttgttatggaagaattcaaatataaataaaaaattgtgagtaataaaatgaactcacagtttcaacaatgacccacaaaaaaaaaaaaaaaaaaaaaaaaaaaaaaa

SEQ ID NO: 127 - DNA, 1783 bp, Homo sapiens
aaggaataaagttgctgattcattcctttacactgaaaccctttgttgtgccctcctcttccttcctctttatagggagacactctgagaaagagcacattgtgggggcccactccatgtgatgtttgcttggttgcctgttcccttttctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaccttctcctggctcatttaaaacgctatgcggaatctggggacgcatttgacatccagaggtgctactgcaattacaccacagatgtggttgccagcgtcccgtttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagccg

SEQ ID NO: 128 - DNA, 3800 bp, Homo sapiens
gcatactgctagtggcgcgcggaggagcgacgcgtggagaagcggcccacgtgtctgcccagagtcaagtcctgtgttcttcccgctccttacgcatccgcggtccagggcgccctttcagccccgctggtgttcgcccaccccgggccgcgtgagtggggccccacgcagctccccgcactccgtgggccaacttggccaagcaactctgtccggggagcggtgcttgcggggggtgagtaccgggcactgcgcatgcggagctccaaattcaaacagctgttttcagaggctggagggcgggcggactggtagcagctggggctaggagaggctttctctaggaggcggccgctcgggagccatggtggaccggggccctctgctcacctcggccatcatcttctacctggccatcggggcggcgatcttcgaagtgctggaggagccacactggaaggaggccaagaaaaactactacacacagaagctgcatctgctcaaggagttcccgtgcctgggtcaggagggcctggacaagatcctagaggtggtatctgatgctgcaggacagggtgtggccatcacagggaaccagaccttcaacaactggaactggcccaatgcaatgatttttgcagcgaccgtcattaccaccattggatatggcaatgtggctcccaagacccccgccggtcgcctcttctgtgttttctatggtctcttcggggtgccgctctgcctgacgtggatcagtgccctgggcaagttcttcgggggacgtgccaagagactagggcagttccttaccaagagaggtgtgagtctgcggaaggcgcagatcacgtgcacagtcatcttcatcgtgtggggcgtcctagtccacctggtgatcccacccttcgtattcatggtgactgaggggtggaactacatcgagggcctctactactccttcatcaccatctccaccatcggcttcggtgactttgtggccggtgtgaaccccagcgccaactaccacgccctgtaccgctacttcgtggagctctggatctacttggggctggcctggctgtccctttttgtcaactggaaggtgagcatgtttgtggaagtccacaaagccattaagaagcggcggcggcgacggaaggagtcctttgagagctccccacactcccggaaggccctgcaggtgaaggggagcacagcctccaaggacgtcaacatcttcagctttctttccaagaaggaagagacctacaacgacctcatcaagcagatcgggaagaaggccatgaagacaagcgggggtggggagacgggcccgggcccagggctggggcctcaaggcggtgggctcccagcactgcccccttccctggtgcccctggtagtctactccaagaaccgggtgcccaccttggaagaggtgtcacagacactgaggagcaaaggccacgtatcaaggtccccagatgaggaggctgtggcacgggcccctgaagacagctcccctgcccccgaggtgttcatgaaccagctggaccgcatcagcgaggaatgcgagccatgggacgcccaggactaccacccactcatcttccaggacgccagcatcaccttcgtgaacacggaggctggcctctcagacgaggagacctccaagtcctcgctagaggacaacttggcaggggaggagagcccccagcagggggctgaagccaaggcgcccctgaacatgggcgagttcccctcctcctccgagtccaccttcaccagcactgagtctgagctctctgtgccttacgaacagctgatgaatgagtacaacaaggctaacagccccaagggcacatgaggcagggccggctccccaccccacctttgatggcctcttcccccctcaccctagggtgtcccgagatgaccgggacgcctggcccctggtgggggggcagcctcggaactgggagtggggggccaggggccttcctaaccttccatcatcctcagctagatgtatgcccgggacagggcctctgttctccagctgaaccataccctggctgtgggggcatctgtcctgagcttggctggtgtatctcacaatgcaaagacatgctggctggcgggacaggtgggcaggactgaccctgaggaggccttgcctgcagggtctttgtctcaccatttggtggagtatcacacggttctctgaggtctggggcctcagctgtttaagtttaccggtattactgagctcggcatttggagagggagctctgaagtgtctggggaggtaccgctgtgcgtggggtcaggtgtttccgtaccacagcaggagcagggcccgcccgcatcccagctgtgggcctgccggtcaggtcgggcacctactacaaaccgtagtggggtggaggctgctggaggtgggagtgaggagatgagggcagggtctcaaacagtcctgactcacagggcctggaaacaagtcctatgtgggcctggggcctggggtcctcatcctccttgttggtctactcaggcccagcccagagctgtgttccctgtctcaggtcaagcagtggcagacgcaaggctttctgtgggcccccaagtggtaggagggagagtagcagagcatgggttactggaagccgggactgctagggctggtggccagggagctgcaagagtgaggctcagctctggctggttctgcccttacccctcctgcccgcctgagaactgcacaccctgcccgctggccccaggacctgcactcccaatcctgctgtcttctccttccctgtgccctgaacaaggacctcactgcccgccttcccctcccaccagcccccttgggccaggcagggtgaggccaaattgctcttggcccacaaatgggtgatggtcagatatgtgaatcaagctcctttctctagctagtgtttgatgtgcacgtgtgtgtgcacagtgcgtgtgtgcacacgcacacctgtgcactcgtgtgtgtttaagaaaggaaaggatttgggctggggagcaaaagataatgtgaaactgttggtggactctctggtgaggggtgggcagaacttgctgctactagagttcttgggttctccatgatgttcaccctggggctggcccactgtgtcctgaatgtttttgttattttttgttttattttttaaacaaactgctgtttttatatacctggaatctgttgttggcttcagagccagtggttaaagagcagggtcccaaggattgggagatctagtgtctgccctcctgccctgcaactcaattgggcctttttcggtgacctcatccaaggccatgatgtcaagggccatgtccccaagcagaggtggagaaggggacactgaggtgagcaaaagcaggaaggggcatccactgcgggtgactggaggccgggcaggaagcaagtcatcagagccgctcagctccgttcactctctgccttctgccccactactgtggggcagtggggccagagcccacctccccaacatgtgaagacagtgatgggcacgtgcccacacccccacttctctagccgtttgcagaggccgccacccagcaggggcctgaaaaggagcagcctcgtatttttctgtgaaatgttttaatgaaccatgttgttgctggttgtcctggcatcgcgcacactgtatgtacatactggcaacgatgtcaaatgtaatttattttaacatttttacaataaaacatgaggtggacaggccaaaaaaaaaaaaaaaaaa

SEQ ID NO: 129 - protein, 574 aa, Homo sapiens
MCPRAARAPATLLLALGAVLWPAAGAWELTILHTNDVHSRLEQTSEDSSKCVNASRCMGGVARLFTKVQQIRRAEPNVLLLDAGDQYQGTIWFTVYKGAEVAHFMNALRYDAMALGNHEFDNGVEGLIEPLLKEAKFPILSANIKAKGPLASQISGLYLPYKVLPVGDEVVGIVGYTSKETPFLSNPGTNLVFEDEITALQPEVDKLKTLNVNKIIALGHSGFEMDKLIAQKVRGVDVVVGGHSNTFLYTGNPPSKEVPAGKYPFIVTSDDGRKVPVVQAYAFGKYLGYLKIEFDERGNVISSHGNPILLNSSIPEDPSIKADINKWRIKLDNYSTQELGKTIVYLDGSSQSCRFRECNMGNLICDAMINNNLRHTDEMFWNHVSMCILNGGGIRSPIDERNNGTITWENLAAVLPFGGTFDLVQLKGSTLKKAFEHSVHRYGQSTGEFLQVGGIHVVYDLSRKPGDRVVKLDVLCTKCRVPSYDPLKMDEVYKVILPNFLANGGDGFQMIKDELLRHDSGDQDINVVSTYISKMKVIYPAVEGRIKFSTGSHCHGSFSLIFLSLWAVIFVLYQ

SEQ ID NO: 130 - protein, 169 aa, Homo sapiens
MTAGRRMEMLCAGRVPALLLCLGFHLLQAVLSTTVIPSCIPGESSDNCTALVQTEDNPRVAQVSITKCSSDMNGYCLHGQCIYLVDMSQNYCRCEVGYTGVRCEHFFLTVHQPLSKEYVALTVILIILFLITVVGSTYYFCRWYRNRKSKEPKKEYERVTSGDPELPQV

SEQ ID NO: 131 - protein, 252 aa, Homo sapiens
MRAPLLPPAPVVLSLLILGSGHYAAGLDLNDTYSGKREPFSGDHSADGFEVTSRSEMSSGSEISPVSEMPSSSEPSSGADYDYSEEYDNEPQIPGYIVDDSVRVEQVVKPPQNKTESENTSDKPKRKKKGGKNGKNRRNRKKKNPCNAEFQNFCIHGECKYIEHLEAVTCKCQQEYFGERCGEKSMKTHSMIDSSLSKIALAAIAAFMSAVILTAVAVITVQLRRQYVRKYEGEAEERKKLRQENGNVHAIA

SEQ ID NO: 132 - protein, 148 aa, Homo sapiens
MKALIVLGLVLLSVTVQGKVFERCELARTLKRLGMDGYRGISLANWMCLAKWESGYNTRATNYNAGDRSTDYGIFQINSRYWCNDGKTPGAVNACHLSCSALLQDNIADAVACAKRVVRDPQGIRAWVAWRNRCQNRDVRQYVQGCGV

SEQ ID NO: 133 - protein, 180 aa, Homo sapiens
MASTSYDYCRVPMEDGDKRCKLLLGIGILVLLIIVILGVPLIIFTIKANSEACRDGLRAVMECRNVTHLLQQELTEAQKGFQDVEAQAATCNHTVMALMASLDAEKAQGQKKVEELEGEITTLNHKLQDASAEVERLRRENQVLSVRIADKKYYPSSQDSSSAAAPQLLIVLLGLSALLQ

SEQ ID NO: 134 - protein, 381 aa, Homo sapiens
MIDTLRPVPFASEMAISKTVAWLNEQLELGNERLLLMDCRPQELYESSHIESAINVAIPGIMLRRLQKGNLPVRALFTRGEDRDRFTRRCGTDTVVLYDESSSDWNENTGGESVLGLLLKKLKDEGCRAFYLEGGFSKFQAEFSLHCETNLDGSCSSSSPPLPVLGLGGLRISSDSSSDIESDLDRDPNSATDSDGSPLSNSQPSFPVEILPFLYLGCAKDSTNLDVLEEFGIKYILNVTPNLPNLFENAGEFKYKQIPISDHWSQNLSQFFPEAISFIDEARGKNCGVLVHCLAGISRSVTVTVAYLMQKLNLSMNDAYDIVKMKKSNISPNFNFMGQLLDFERTLGLSSPCDNRVPAQQLYFTTPSNQNVYQVDSLQST

SEQ ID NO: 135 - protein, 847 aa, Homo sapiens
MEPWKQCAQWLIHCKVLPTNHRVTWDSAQVFDLAQTLRDGVLLCQLLNNLRAHSINLKEINLRPQMSQFLCLKNIRTFLTACCETFGMRKSELFEAFDLFDVRDFGKVIETLSRLSRTPIALATGIRPFPTEESINDEDIYKGLPDLIDETLVEDEEDLYDCVYGEDEGGEVYEDLMKAEEAHQPKCPENDIRSCCLAEIKQTEEKYTETLESIEKYFMAPLKRFLTAAEFDSVFINIPELVKLHRNLMQEIHDSIVNKNDQNLYQVFINYKERLVIYGQYCSGVESAISSLDYISKSKEDVKLKLEECSKRANNGKFTLRDLLVVPMQRVLKYHLLLQELVKHTTDPTEKANLKLALDAMKDLAQYVNEVKRDNETLREIKQFQLSIENLNQPVLLFGRPQGDGEIRITTLDKHTKQERHIFLFDLAVIVCKRKGDNYEMKEIIDLQQYKIANNPTTDKENKKWSYGFYLIHTQGQNGLEFYCKTKDLKKKWLEQFEMALSNIRPDYADSNFHDFKMHTFTRVTSCKVCQMLLRGTFYQGYLCFKCGARAHKECLGRVDNCGRVNSGEQGTLKLPEKRTNGLRRTPKQVDPGLPKMQVIRNYSGTPPPALHEGPPLQLQAGDTVELLKGDAHSLFWQGRNLASGEVGFFPSDAVKPCPCVPKPVDYSCQPWYAGAMERLQAETELINRVNSTYLVRHRTKESGEYAISIKYNNEAKHIKILTRDGFFHIAENRKFKSLMELVEYYKHHSLKEGFRTLDTTLQFPYKEPEHSAGQRGNRAGNSLLSPKVLGIAIARYDFCARDMRELSLLKGDVVKIYTKMSANGWWRGEVNGRVGWFPSTYVEEDE

SEQ ID NO: 136 - protein, 847 aa, Homo sapiens; identical to SEQ ID NO: 135

SEQ ID NO: 137 - protein, 99 aa, Homo sapiens
MKVSAALLCLLLIAATFIPQGLAQPDAINAPVTCCYNFTNRKISVQRLASYRRITSSKCPKEAVIFKTIVAKEICADPKQKWVQDSMDHLDKQTQTPKT

SEQ ID NO: 138 - protein, 733 aa, Homo sapiens
MERRSESPCLRDSPDRRSGSPDVKGPPPVKVARLEQNGSPMGARGRPNGAVAKAVGGLMIPVFCVVEQLDGSLEYDNREEHAEFVLVRKDVLFSQLVETALLALGYSHSSAAQAQGIIKLGRWNPLPLSYVTDAPDATVADMLQDVYHVVTLKIQLQSCSKLEDLPAEQWNHATVRNALKELLKEMNQSTLAKECPLSQSMISSIVNSTYYANVSATKCQEFGRWYKKYKKIKVERVERENLSDYCVLGQRPMHLPNMNQLASLGKTNEQSPHSQIHHSTPIRNQVPALQPIMSPGLLSPQLSPQLVRQQIAMAHLINQQIAVSRLLAHQHPQAINQQFLNHPPIPRAVKPEPTNSSVEVSPDIYQQVRDELKRASVSQAVFARVAFNRTQGLLSEILRKEEDPRTASQSLLVNLRAMQNFLNLPEVERDRIYQDERERSMNPNVSMVSSASSSPSSSRTPQAKTSTPTTDLPIKVDGANINITAAIYDEIQQEMKRAKVSQALFAKVAANKSQGWLCELLRWKENPSPENRTLWENLCTIRRFLNLPQHERDVIYEEESRHHHSERMQHVVQLPPEPVQVLHRQQSQPAKESSPPREEAPPPPPPTEDSCAKKPRSRTKISLEALGILQSFIHDVGLYPDQEAIHTLSAQLDLPKHTIIKFFQNQRYHVKHHGKLKEHLGSAVDVAEYKDEELLTESEENDSEEGSEEMYKVEAEEENADKSKAAPAEIDQR

SEQ ID NO: 139 - protein, 1782 aa, Homo sapiens
MGAGSSTEQRSPEQPPEGSSTPAEPEPSGGGPSAEAAPDTTADPAIAASDPATKLLQKNGQLSTINGVAEQDELSLQEGDLNGQKGALNGQGALNSQEEEEVIVTEVGQRDSEDVSKRDSDKEMATKSAVVHDITDDGQEETPEIIEQIPSSESNLEELTQPTESQANDIGFKKVFKFVGFKFTVKKDKTEKPDTVQLLTVKKDEGEGAAGAGDHKDPSLGAGEAASKESEPKQSTEKPEETLKREQSHAEISPPAESGQAVEECKEEGEEKQEKEPSKSAESPTSPVTSETGSTFKKFFTQGWAGWRKKTSFRKPKEDEVEASEKKKEQEPEKVDTEEDGKAEVASEKLTASEQAHPQEPAESAHEPRLSAEYEKVELPSEEQVSGSQGPSEEKPAPLATEVFDEKIEVHQEEVVAEVHVSTVEERTEEQKTEVEETAGSVPAEELVEMDAEPQEAEPAKELVKLKETCVSGEDPTQGADLSPDEKVLSKPPEGVVSEVEMLSSQERMKVQGSPLKKLFTSTGLKKLSGKKQKGKRGGGDEESGEHTQVPADSPDSQEEQKGESSASSPEEPEEITCLEKGLAEVQQDGEAEEGATSDGEKKREGVTPWASFKKMVTPKKRVRRPSESDKEDELDKVKSATLSSTESTASEMQEEMKGSVEEPKPEEPKRKVDTSVSWEALICVGSSKKRARRGSSSDEEGGPKAMGGDHQKADEAGKDKETGTDGILAGSQEHDPGQGSSSPEQAGSPTEGEGVSTWESFKRLVTPRKKSKSKLEEKSEDSIAGSGVEHSTPDTEPGKEESWVSIKKFIPGRRKKRPDGKQEQAPVEDAGPTGANEDDSDVPAVVPLSEYDAVEREKMEAQQAQKSAEQPEQKAATEVSKELSESQVHMMAAAVADGTRAATIIEERSPSWISASVTEPLEQVEAEAALLTEEVLEREVIAEEEPPTVTEPLPENREARGDTVVSEAELTPEAVTAAETAGPLGAEEGTEASAAEETTEMVSAVSQLTDSPDTTEEATPVQEVEGGVPDIEEQERRTQEVLQAVAEKVKEESQLPGTGGPEDVLQPVQRAEAERPEEQAEASGLKKETDVVLKVDAQEAKTEPFTQGKVVGQTTPESFEKAPQVTESIESSELVTTCQAETLAGVKSQEMVMEQAIPPDSVETPTDSETDGSTPVADFDAPGTTQKDEIVEIHEENEVASGTQSGGTEAEAVPAQKERPPAPSSFVFQEETKEQSKMEDTLEHTDKEVSVETVSILSKTEGTQEADQYADEKTKDVPFFEGLEGSIDTGITVSREKVTEVALKGEGTEEAECKKDDALELQSHAKSPPSPVEREMVVQVEREKTEAEPTHVNEEKLEHETAVTVSEEVSKQLLQTVNVPIIDGAKEVSSLEGSPPPCLGQEEAVCTKIQVQSSEASFTLTAAAEEEKVLGETANILETGETLEPAGAHLVLEEKSSEKNEDFAAHPGEDAVPTGPDCQAKSTPVIVSATTKKGLSSDLEGEKTTSLKWKSDEVDEQVACQEVKVSVAIEDLEPENGILELETKSSKLVQNIIQTAVDQFVRTEETATEMLTSELQTQAHVIKADSQDAGQETEKEGEEPQASAQDETPITSAKEESESTAVGQAHSDISKDMSEASEKTMTVEVEGSTVNDQQLEEVVLPSEEEGGGAGTKSVPEDDGHALLAERIEKSLVEPKEDEKGDDVDDPENQNSALADTDASGGLTKESPDTNGPKQKEKEDAQEVELQEGKVHSESDKAITPQAQEELQKQERESAKSELTES

SEQ ID NO: 140 - protein, 438 aa, Homo sapiens
MVQWKRLCQLHYLWALGCYMLLATVALKLSFRLKCDSDHLGLESRESQSQYCRNILYNFLKLPAKRSINCSGVTRGDQEAVLQAILNNLEVKKKREPFTDTHYLSLTRDCEHFKAERKFIQFPLSKEEVEFPIAYSMVIHEKIENFERLLRAVYAPQNIYCVHVDEKSPETFKEAVKAIISCFPNVFIASKLVRVVYASWSRVQADLNCMEDLLQSSVPWKYFLNTCGTDFPIKSNAEMVQALKMLNGRNSMESEVPPKHKETRWKYHFEVVRDTLHLTNKKKDPPPYNLTMFTGNAYIVASRDFVQHVLKNPKSQQLIEWVKDTYSPDEHLWATLQRARWMPGSVPNHPKYDISDMTSIARLVKWQGHEGDIDKGAPYAPCSGIHQRAICVYGAGDLNWMLQNHHLLANKFDPKVDDNALQCLEEYLRYKAIYGTEL

SEQ ID NO: 141 - protein, 414 aa, Homo sapiens
MAAAPPSYCFVAFPPRAKDGLVVFGKNSARPRDEVQEVVYFSAADHEPESKVECTYISIDQVPRTYAIMISRPAWLWGAEMGANEHGVCIANEAINTREPAAEIEALLGMDLVRLGLERGETAKEALDVIVSLLEEHGQGGNYFEDANSCHSFQSAYLIVDRDEAWVLETIGKYWAAEKVTEGVRCICSQLSLTTKMDAEHPELRSYAQSQGWWTGEGEFNFSEVFSPVEDHLDCGAGKDSLEKQEESITVQTMMNTLRDKASGVCIDSEFFLTTASGVSVLPQNRSSPCIHYFTGTHDPSRSIFKPFIFVDDVKLVPKTQSPCFGDDDPAKKEPRFQEKPDRRHELYKAHEWARAIIESDQEQGRKLRSTMLELEKQGLEAMEEILTSSEPLDPAEVGDLFYDCVDTEIKFFK

SEQ ID NO: 142 - protein, 806 aa, Homo sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCLAGNSIGFSHHSAWLVVLPAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 143 - protein, 160 aa, Homo sapiens
MLPFLFFSTLFSSIFTEAQKQYWVCNSSDASISYTYCDKMQYPISINVNPCIELKGSKGLLHIFYIPRRDLKQLYFNLYITVNTMNLPKRKEVICRGSDDDYSFCRALKGETVNTTISFSFKGIKFSKGKYKCVVEAISGSPEEMLFCLEFVILHQPNSN

SEQ ID NO: 144 - protein, 381 aa, Homo sapiens
MPFSNSHNALKLRFPAEDEFPDLSAHNNHMAKVLTPELYAELRAKSTPSGFTLDDVIQTGVDNPGHPYIMTVGCVAGDEESYEVFKDLFDPIIEDRHGGYKPSDEHKTDLNPDNLQGGDDLDPNYVLSSRVRTGRSIRGFCLPPHCSRGERRAIEKLAVEALSSLDGDLAGRYYALKSMTEAEQQQLIDDHFLFDKPVSPLLLASGMARDWPDARGIWHNDNKTFLVWVNEEDHLRVISMQKGGNMKEVFTRFCTGLTQIETLFKSKDYEFMWNPHLGYILTCPSNLGTGLRAGVHIKLPNLGKHEKFSEVLKRLRLQKRGTGGVDTAAVGGVFDVSNADRLGFSEVELVQMVVDGVKLLIEMEQRLEQGQAIDDLMPAQK

SEQ ID NO: 145 - protein, 729 aa, Homo sapiens
MGKKYKNIVLLKGLEVINDYHFRMVKSLLSNDLKLNLKMREEYDKIQIADLMEEKFRGDAGLGKLIKIFEDIPTLEDLAETLKKEKLKVKGPALSRKRKKEVDATSPAPSTSSTVKTEGAEATPGAQKRKKSTKEKAGPKGSKVSEEQTQPPSPAGAGMSTAMGRSPSPKTSLSAPPNTSSTENPKTVAKCQVTPRRNVLQKRPVIVKVLSTTKPFEYETPEMEKKIMFHATVATQTQFFHVKVLNTSLKEKFNGKKIIIISDYLEYDSLLEVNEESTVSEAGPNQTFEVPNKIINRAKETLKIDILHKQASGNIVYGVFMLHKKTVNQKTTIYEIQDDRGKMDVVGTGQCHNIPCEEGDKLQLFCFRLRKKNQMSKLISEMHSFIQIKKKTNPRNNDPKSMKLPQEQSQLPNPSEASTTFPESHLRTPQMPPTTPSSSFFTKKSEDTISKMNDFMRMQILKEGSHFPGPFMTSIGPAESHPHTPQMPPSTPSSSFLTTLKPRLKTEPEEVSIEDSAQSDLKEVMVLNATESFVYEPKEQKKMFHATVATENEVFRVKVFNIDLKEKFTPKKIIAIANYVCRNGFLEVYPFTLVADVNADRNMEIPKGLIRSASVTPKINQLCSQTKGSFVNGVFEVHKKNVRGEFTYYEIQDNTGKMEVVVHGRLTTINCEEGDKLKLTCFELAPKSGNTGELRSVIHSHIKVIKTRKNKKDILNPDSSMETSPDFFF

SEQ ID NO: 146 - protein, 343 aa, Homo sapiens
MAQKGVLGPGQLGAVAILLYLGLLRSGTGAEGAEAPCGVAPQARITGGSSAVAGQWPWQVSITYEGVHVCGGSLVSEQWVLSAAHCFPSEHHKEAYEVKLGAHQLDSYSEDAKVSTLKDIIPHPSYLQEGSQGDIALLQLSRPITFSRYIRPICLPAANASFPNGLHCTVTGWGHVAPSVSLLTPKPLQQLEVPLISRETCNCLYNIDAKPEEPHFVQEDMVCAGYVEGGKDACQGDSGGPLSCPVEGLWYLTGIVSWGDACGARNRPGVYTLASSYASWIQSKVTELQPRVVPQTQESQPDSNLCGSHLAFSSAPAQGLLRPILFLPLGLALGLLSPWLSEH

SEQ ID NO: 147 - protein, 398 aa, Homo sapiens
MLRLYVLVMGVSAFTLQPAAHTGAARSCRFRGRHYKREFRLEGEPVALRCPQVPYWLWASVSPRINLTWHKNDSARTVPGEEETRMWAQDGALWLLPALQEDSGTYVCTTRNASYCDKMSIELRVFENTDAFLPFISYPQILTLSTSGVLVCPDLSEFTRDKTDVKIQWYKDSLLLDKDNEKFLSVRGTTHLLVHDVALEDAGYYRCVLTFAHEGQQYNITRSIELRIKKKKEETIPVIISPLKTISASLGSRLTIPCKVFLGTGTPLTTMLWWTANDTHIESAYPGGRVTEGPRQEYSENNENYIEVPLIFDPVTREDLHMDFKCVVHNTLSFQTLRTTVKEASSTFSWGIVLAPLSLAFLVLGGIWMHRRCKHRTGKADGLTVLWPHHQDFQSYPK

SEQ ID NO: 148 - protein, 482 aa, Homo sapiens
MDEGIPHLQERQLLEHRDFIGLDYSSLYMCKPKRSMKRDDTKDTYKLPHRLIEKKRRDRINECIAQLKDLLPEHLKLTTLGHLEKAVVLELTLKHLKALTALTEQQHQKIIALQNGERSLKSPIQSDLDAFHSGFQTCAKEVLQYLSRFESWTPREPRCVQLINHLHAVATQFLPTPQLLTQQVPLSKGTGAPSAAGSAAAPCLERAGQKLEPLAYCVPVIQRTQPSAELAAENDTDTDSGYGGEAEARPDREKGKGAGASRVTIKQEPPGEDSPAPKRMKLDSRGGGSGGGPGGGAAAAAAALLGPDPAAAAALLRPDAALLSSLVAFGGGGGAPFPQPAAAAAPFCLPFCFLSPSAAAAYVQPFLDKSGLEKYLYPAAAAAPFPLLYPGIPAPAAAAAAAAAAAAAAAAFPCLSSVLSPPPEKAGAAAATLLPHEVAPLGAPHPQHPHGRTHLPFAGPREPGNPESSAQEDPSQPGKEAP

SEQ ID NO: 149 - protein, 266 aa, Homo sapiens
MVCLKLPGGSCMAALTVTLTVLSSPLALAGDTQPRFLEQAKCECHFLNGTERVWNLIRYIYNQEEYARYNSDLGEYQAVTELGRPDAEYWNSQKDLLERRRAEVDTYCRYNYGVVESFTVQRRVQPKVTVYPSKTQPLQHHNLLVCSVNGFYPGSIEVRWFRNGQEEKAGVVSTGLIQNGDWTFQTLVMLETVPRSGEVYTCQVEHPSMMSPLTVQWSARSESAQSKMLSGVGGFVLGLLFLGTGLFIYFRNQKGHSGLQPTGLLS

SEQ ID NO: 150 - protein, 1156 aa, Homo sapiens
MSKLRMVLLEDSGSADFRRHFVNLSPFTITVVLLLSACFVTSSLGGTDKELRLVDGENKCSGRVEVKVQEEWGTVCNNGWSMEAVSVICNQLGCPTAIKAPGWANSSAGSGRIWMDHVSCRGNESALWDCKHDGWGKHSNCTHQQDAGVTCSDGSNLEMRLTRGGNMCSGRIEIKFQGRWGTVCDDNFNIDHASVICRQLECGSAVSFSGSSNFGEGSGPIWFDDLICNGNESALWNCKHQGWGKHNCDHAEDAGVICSKGADLSLRLVDGVTECSGRLEVRFQGEWGTICDDGWDSYDAAVACKQLGCPTAVTAIGRVNASKGFGHIWLDSVSCQGHEPAVWQCKHHEWGKHYCNHNEDAGVTCSDGSDLELRLRGGGSRCAGTVEVEIQRLLGKVCDRGWGLKEADVVCRQLGCGSALKTSYQVYSKIQATNTWLFLSSCNGNETSLWDCKNWQWGGLTCDHYEEAKITCSAHREPRLVGGDIPCSGRVEVKHGDTWGSICDSDFSLEAASVLCRELQCGTVVSILGGAHFGEGNGQIWAEEFQCEGHESHLSLCPVAPRPEGTCSHSRDVGVVCSRYTEIRLVNGKTPCEGRVELKTLGAWGSLCNSHWDIEDAHVLCQQLKCGVALSTPGGARFGKGNGQIWRHMFHCTGTEQHMGDCPVTALGASLCPSEQVASVICSGNQSQTLSSCNSSSLGPTRPTIPEESAVACIESGQLRLVNGGGRCAGRVEIYHEGSWGTICDDSWDLSDAHVVCRQLGCGEAINATGSAHFGEGTGPIWLDEMKCNGKESRIWQCHSHGWGQQNCRHKEDAGVICSEFMSLRLTSEASREACAGRLEVFYNGAWGTVGKSSMSETTVGVVCRQLGCADKGKINPASLDKAMSIPMWVDNVQCPKGPDTLWQCPSSPWEKRLASPSEETWITCDNKIRLQEGPTSCSGRVEIWHGGSWGTVCDDSWDLDDAQVVCQQLGCGPALKAFKEAEFGQGTGPIWLNEVKCKGNESSLWDCPARRWGHSECGHKEDAAVNCTDISVQKTPQKATTGRSSRQSSFIAVGILGVVLLAIFVALFFLTKKRRQRQRLAVSSRGENLVHQIQYREMNSCLNADDLDLMNSSENSHESADFSAAELISVSKFLPISGMEKEAILSHTEKENGNL

SEQ ID NO: 151 - protein, 1156 aa, Homo sapiens; identical to SEQ ID NO: 150

SEQ ID NO: 152 - protein, 635 aa, Homo sapiens
MVSQSTVRQDSPVEPWEGISDHSGIIDGSPRLLNTDHPPCQLDIRLMRHKAVWINPQDVQQQPQDLQSQVPAAGNSGTHFVTDAASPSGPSPSCLGDSLAETTLSEDTTDSVGSASPHGSSEKSSSFSLSSTEVHMVRPGYSHRVSLPTSPRILATSPYPETDSAFFEPSHLTSAADEGAVQVSRRTISSNSFSPEVFVLPVDVEKENAHFYVADMIISAMEKMKCNILSQQQTESWSKEVSGLLGSDQPDSEMTFDTNIKQESGSSTSSYSGYEGCAVLQVSPVTETRTYHDVKEICKCDVDEFVILELGDFNDITETCSCSCSSSKSVTYEPDFNSAELLAKELYRVFQKCWILSVVNSQLAGSLSAAGSIVVNEECVRKDFESSMNVVQEIKFKSRIRGTEDWAPPRFQIIFNIHPPLKRDLVVAAQNFFCAGCGTPVEPKFVKRLRYCEYLGKYFCDCCHSYAESCIPARILMMWDFKKYYVSNFSKQLLDSIWHQPIFNLLSIGQSLYAKAKELDRVKEIQEQLFHIKKLLKTCRFANSCVKERALFVNFARIRLSSSHFRQQHVEDVQRAGLAFTNSASSPPSAPGVRGSQRGENFWKVWPLQQHDAPEYCEKDCSTCLMITPICVYYW

SEQ ID NO: 153 - protein, 97 aa, Homo sapiens
MKVSAALLWLLLIAAAFSPQGLAGPASVPTTCCFNLANRKIPLQRLESYRRITSGKCPQKAVIFKTKLAKDICADPKKKWVQDSMKYLDQKSPTPKP

SEQ ID NO: 154 - protein, 739 aa, Homo sapiens
MSSESKEQHNVSPRDSAEGNDSYPSGIHLELQRESSTDFKQFETNDQCRPYHRILIERQEKSDTNFKEFVIKKLQKNCQCSPAKAKNMILGFLPVLQWLPKYDLKKNILGDVMSGLIVGILLVPQSIAYSLLAGQEPVYGLYTSFFASIIYFLLGTSRHISVGIFGVLCLMIGETVDRELQKAGYDNAHSAPSLGMVSNGSTLLNHTSDRICDKSCYAIMVGSTVTFIAGVYQVAMGFFQVGFVSVYLSDALLSGFVTGASFTILTSQAKYLLGLNLPRTNGVGSLITTWIHVFRNIHKTNLCDLITSLLCLLVLLPTKELNEHFKSKLKAPIPIELVVVVAATLASHFGKLHENYNSSIAGHIPTGFMPPKVPEWNLIPSVAVDAIAISIIGFAITVSLSEMFAKKHGYTVKANQEMYAIGFCNIIPSFFHCFTTSAALAKTLVKESTGCHTQLSGVVTALVLLLVLLVIAPLFYSLQKSVLGVITIVNLRGALRKFRDLPKMWSISRMDTVIWFVTMLSSALLSTEIGLLVGVCFSIFCVILRTQKPKSSLLGLVEESEVFESVSAYKNLQTKPGIKIFRFVAPLYYINKECFKSALYKQTVNPILIKVAWKKAAKRKIKEKVVTLGGIQDEMSVQLSHDPLELHTIVIDCSAIQFLDTAGIHTLKEVRRDYEAIGIQVLLAQCNPTVRDSLTNGEYCKKEEENLLFYSVYEAMAFAEVSKNQKGVCVPNGLSLSSD

SEQ ID NO: 155 - protein, 261 aa, Homo sapiens
MSWKKALRIPGGLRAATVTLMLSMLSTPVAEGRDSPEDFVYQFKGMCYFTNGTERVRLVSRSIYNREEIVRFDSDVGEFRAVTLLGLPAAEYWNSQKDILERKRAAVDRVCRHNYQLELRTTLQRRVEPTVTISPSRTEALNHHNLLVCSVTDFYPAQIKVRWFRNDQEETAGVVSTPLIRNGDWTFQILVMLEMTPQRGDVYTCHVEHPSLQSPITVEWRAQSESAQSKMLSGIGGFVLGLIFLGLGLIIHHRSQKGLLH

SEQ ID NO: 156 - protein, 915 aa, Homo sapiens
MARRSSFQSCQIISLFTFAVGVNICLGFTAHRIKRAEGWEEGPPTVLSDSPWTNISGSCKGRCFELQEAGPPDCRCDNLCKSYTSCCHDFDELCLKTARGWECTKDRCGEVRNEENACHCSEDCLARGDCCTNYQVVCKGESHWVDDDCEEIKAAECPAGFVRPPLIIFSVDGFRASYMKKGSKVMPNIEKLRSCGTHSPYMRPVYPTKTFPNLYTLATGLYPESHGIVGNSMYDPVFDATFHLRGREKFNHRWWGGQPLWITATKQGVKAGTFFWSVVIPHERRILTILQWLTLPDHERPSVYAFYSEQPDFSGHKYGPFGPEESSYGSPFTPAKRPKRKVAPKRRQERPVAPPKKRRRKIHRMDHYAAETRQDKMTNPLREIDKIVGQLMDGLKQLKLHRCVNVIFVGDHGMEDVTCDRTEFLSNYLTNVDDITLVPGTLGRIRSKFSNNAKYDPKAIIANLTCKKPDQHFKPYLKQHLPKRLHYANNRRIEDIHLLVERRWHVARKPLDVYKKPSGKCFFQGDHGFDNKVNSMQTVFVGYGSTFKYKTKVPPFENIELYNVMCDLLGLKPAPNNGTHGSLNHLLRTNTFRPTMPEEVTRPNYPGIMYLQSDFDLGCTCDDKVEPKNKLDELNKRLHTKGSTEERHLLYGRPAVLYRTRYDILYHTDFESGYSEIFLMPLWTSYTVSKQAEVSSVPDHLTSCVRPDVRVSPSFSQNCLAYKNDKQMSYGFLFPPYLSSSPEAKYDAFLVTNMVPMYPAFKRVWNYFQRVLVKKYASERNGVNVISGPIFDYDYDGLHDTEDKIKQYVEGSSIPVPTHYYSIITSCLDFTQPADKCDGPLSVSSFILPHRPDNEESCNSSEDESKWVEELMKMHTARVRDIEHLTSLDFFRKTSRSYPEILTLKTYLHTYESEI

SEQ ID NO: 157 - protein, 247 aa, Homo sapiens
MNLLLILTFVAAAVAAPFDDDDKIVGGYICEENSVPYQVSLNSGYHFCGGSLISEQWVVSAGHCYKSRIQVRLGEHNIEVLEGNEQFINAAKIIRHPKYNSRTLDNDILLIKLSSPAVINSRVSAISLPTAPPAAGTESLISGWGNTLSSGADYPDELQCLDAPVLSQAECEASYPGKITNNMFCVGFLEGGKDSCQGDSGGPVVSNGELQGIVSWGYGCAQKNRPGVYTKVYNYVDWIKDTIAANS

SEQ ID NO: 158 - protein, 352 aa, Homo sapiens
MEGISIYTSDNYTEEMGSGDYDSMKEPCFREENANFNKIFLPTIYSIIFLTGIVGNGLVILVMGYQKKLRSMTDKYRLHLSVADLLFVITLPFWAVDAVANWYFGNFLCKAVHVIYTVNLYSSVLILAFISLDRYLAIVHATNSQRPRKLLAEKVVYVGVWIPALLLTIPDFIFANVSEADDRYICDRFYPNDLWVVVFQFQHIMVGLILPGIVILSCYCIIISKLSHSKGHQKRKALKTTVILILAFFACWLPYYIGISIDSFILLEIIKQGCEFENTVHKWISITEALAFFHCCLNPILYAFLGAKFKTSAQHALTSVSRGSSLKILSKGKRGGHSSVSTESESSSFHSS

SEQ ID NO: 159 - protein, 375 aa, Homo sapiens
MDALQLANSAFAVDLFKQLCEKEPLGNVLFSPICLSTSLSLAQVGAKGDTANEIGQVLHFENVKDIPFGFQTVTSDVNKLSSFYSLKLIKRLYVDKSLNLSTEFISSTKRPYAKELETVDFKDKLEETKGQINNSIKDLTDGHFENILADNSVNDQTKILVVNAAYFVGKWMKKFPESETKECPFRLNKTDTKPVQMMNMEATFCMGNIDSINCKIIELPFQNKHLSMFILLPKDVEDESTGLEKIEKQLNSESLSQWTNPSTMANAKVKLSIPKFKVEKMIDPKACLENLGLKHIFSEDTSDFSGMSETKGVALSNVIHKVCLEITEDGGDSIEVPGARILQHKDELNADHPFIYIIRHNKTRNIIFFGKFCSP

SEQ ID NO: 160 - protein, 258 aa, Homo sapiens
MMVLQVSAAPRTVALTALLMVLLTSVVQGRATPENYLFQGRQECYAFNGTQRFLERYIYNREEFARFDSDVGEFRAVTELGRPAAEYWNSQKDILEEKRAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKKVQRGSA

SEQ ID NO: 161 - protein, 93 aa, Homo sapiens
MEFDLNGNGDIDIMSLKRMLEKLGVPKTHLELKKLIGEVSSGSGETFSYPDFLRMMLGKRSAILKMILMYEEKAREKEKPTGPPAKKAISELP

SEQ ID NO: 162 - protein, 99 aa, Homo sapiens
MTSKLAVALLAAFLISAALCEGAVLPRSAKELRCQCIKTYSKPFHPKFIKELRVIESGPHCANTEIIVKLSDGRELCLDPKENWVQRVVEKFLKRAENS

SEQ ID NO: 163 - protein, 99 aa, Homo sapiens; identical to SEQ ID NO: 162

SEQ ID NO: 164 - protein, 133 aa, Homo sapiens
MKPQFVGILLSSLLGAALGNRMRCYNCGGSPSSSCKEAVTTCGEGRPQPGLEQIKLPGNPPVTLIHQHPACVAAHHCNQVETESVGDVTYPAHRDCYLGDLCNSAVASHVAPAGILAAAATALTCLLPGLWSG

SEQ ID NO: 165 - protein, 502 aa, Homo sapiens
MDLIPNLAVETWLLLAVSLVLLYLYGTRTHGLFKRLGIPGPTPLPLLGNVLSYRQGLWKFDTECYKKYGKMWGTYEGQLPVLAITDPDVIRTVLVKECYSVFTNRRSLGPVGFMKSAISLAEDEEWKRIRSLLSPTFTSGKLKEMFPIIAQYGDVLVRNLRREAEKGKPVTLKDIFGAYSMDVITGTSFGVNIDSLNNPQDPFVESTKKFLKFGFLDPLFLSIILFPFLTPVFEALNVSLFPKDTINFLSKSVNRMKKSRLNDKQKHRLDFLQLMIDSQNSKETESHKALSDLELAAQSIIFIFAGYETTSSVLSFTLYELATHPDVQQKLQKEIDAVLPNKAPPTYDAVVQMEYLDMVVNETLRLFPVAIRLERTCKKDVEINGVFIPKGSMVVIPTYALHHDPKYWTEPEEFRPERFSKKKDSIDPYIYTPFGTGPRNCIGMRFALMNMKLALIRVLQNFSFKPCKETQIPLKLDTQGLLQPEKPIVLKVDSRDGTLSGE

SEQ ID NO: 166 - protein, 3396 aa, Homo sapiens
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKPKEATTIDLSILAETASPSLSKEPQMVSDRTTPIIPLVDELPVIPTEFPPVGNIVSFEQKATVQPQAITDSLATKLPTPTGSTKKPWDMDDYSPSASGPLGKLDISEIKEEVLQSTTGVSHYATDSWDGVVEDKQTQESVTQIEQIEVGPLVTSMEILKHIPSKEFPVTETPLVTARMILESKTEKKMVSTVSELVTTGHYGFTLGEEDDEDRTLTVGSDESTLIFDQIPEVITVSKTSEDTIHTHLEDLESVSASTTVSPLIMPDNNGSSMDDWEERQTSGRITEEFLGKYLSTTPFPSQHRTEIELFPYSGDKILVEGISTVIYPSLQTEMTHRRERTETLIPEMRTDTYTDEIQEEITKSPFMGKTEEEVFSGMKLSTSLSEPIHVTESSVEMTKSFDFPTLITKLSAEPTEVRDMEEDFTATPGTTKYDENITTVLLAHGTLSVEAATVSKWSWDEDNTTSKPLESTEPSASSKLPPALLTTVGMNGKDKDIPSFTEDGADEFTLIPDSTQKQLEEVTDEDIAAHGKFTIRFQPTTSTGIAEKSTLRDSTTEEKVPPITSTEGQVYATMEGSALGEVEDVDLSKPVSTVPQFAHTSEVEGLAFVSYSSTQEPTTYVDSSHTIPLSVIPKTDWGVLVPSVPSEDEVLGEPSQDILVIDQTRLEATISPETMRTTKITEGTTQEEFPWKEQTAEKPVPALSSTAWTPKEAVTPLDEQEGDGSAYTVSEDELLTGSERVPVLETTPVGKIDHSVSYPPGAVTEHKVKTDEVVTLTPRIGPKVSLSPGPEQKYETEGSSTTGFTSSLSPFSTHITQLMEETTTEKTSLEDIDLGSGLFEKPKATELIEFSTIKVTVPSDITTAFSSVDRLHTTSAFKPSSAITKKPPLIDREPGEETTSDMVIIGESTSHVPPTTLEDIVAKETETDIDREYFTTSSPPATQPTRPPTVEDKEAFGPQALSTPQPPASTKFHPDINVYIIEVRENKTGRMSDLSVIGHPIDSESKEDEPCSEETDPVHDLMAEILPEFPDIIEIDLYHSEENEEEEEECANATDVTTTPSVQYINGKHLVTTVPKDPEAAEARRGQFESVAPSQNFSDSSESDTHPFVIAKTELSTAVQPNESTETTESLEVTWKPETYPETSEHFSGGEPDVFPTVPFHEEFESGTAKKGAESVTERDTEVGHQAHEHTEPVSLFPEESSGEIAIDQESQKIAFARATEVTFGEEVEKSTSVTYTPTIVPSSASAYVSEEEAVTLIGNPWPDDLLSTKESWVEATPRQVVELSGSSSIPITEGSGEAEEDEDTMFTMVTDLSQRNTTDTLITLDTSRIITESFFEVPATTIYPVSEQPSAKVVPTKFVSETDTSEWISSTTVEEKKRKEEEGTTGTASTFEVYSSTQRSDQLILPFELESPNVATSSDSGTRKSFMSLTTPTQSEREMTDSTPVFTETNTLENLGAQTTEHSSIHQPGVQEGLTTLPRSPASVFMEQGSGEAAADPETTTVSSFSLNVEYAIQAEKEVAGTLSPHVETTFSTEPTGLVLSTVMDRVVAENITQTSREIVISERLGEPNYGAEIRGFSTGFPLEEDFSGDFREYSTVSHPIAKEETVMMEGSGDAAFRDTQTSPSTVPTSVHISHISDSEGPSSTMVSTSAFPWEEFTSSAEGSGEQLVTVSSSVVPVLPSAVQKFSGTASSIIDEGLGEVGTVNEIDRRSTILPTAEVEGTKAPVEKEEVKVSGTVSTNFPQTIEPAKLWSRQEVNPVRQEIESETTSEEQIQEEKSFESPQNSPATEQTIFDSQTFTETELKTTDYSVLTTKKTYSDDKEMKEEDTSLVNMSTPDPDANGLESYTTLPEATEKSHFFLATALVTESIPAEHVVTDSPIKKEESTKHFPKGMRPTIQESDTELLFSGLGSGEEVLPTLPTESVNFTEVEQINNTLYPHTSQVESTSSDKIEDFNRMENVAKEVGPLVSQTDIFEGSGSVTSTTLIEILSDTGAEGPTVAPLPFSTDIGHPQNQTVRWAEEIQTSRPQTITEQDSNKNSSTAEINETTTSSTDFLARAYGFEMAKEFVTSAPKPSDLYYEPSGEGSGEVDIVDSFHTSATTQATRQESSTTFVSDGSLEKHPEVPSAKAVTADGFPTVSVMLPLHSEQNKSSPDPTSTLSNTVSYERSTDGSFQDRFREFEDSTLKPNRKKPTENIIIDLDKEDKDLILTITESTILEILPELTSDKNTIIDIDHTKPVYEDILGMQTDIDTEVPSEPHDSNDESNDDSTQVQEIYEAAVNLSLTEETFEGSADVLASYTQATHDESMTYEDRSQLDHMGFHFTTGIPAPSTETELDVLLPTATSLPIPRKSATVIPEIEGIKAEAKALDDMFESSTLSDGQAIADQSEIIPTLGQFERTQEEYEDKKHAGPSFQPEFSSGAEEALVDHTPYLSIATTHLMDQSVTEVPDVMEGSNPPYYTDTTLAVSTFAKLSSQTPSSPLTIYSGSEASGHTEIPQPSALPGIDVGSSVMSPQDSFKEIHVNIEATFKPSSEEYLHITEPPSLSPDTKLEPSEDDGKPELLEEMEASPTELIAVEGTEILQDFQNKTDGQVSGEAIKMFPTIKTPEAGTVITTADEIELEGATQWPHSTSASATYGVEAGVVPWLSPQTSERPTLSSSPEINPETQAALIRGQDSTIAASEQQVAARILDSNDQATVNPVEFNTEVATPPFSLLETSNETDFLIGINEESVEGTAIYLPGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 167 - protein, 459 aa, Homo sapiens
MAPLCPSPWLPLLIPAPAPGLTVQLLLSLLLLMPVHPQRLPRMQEDSPLGGGSSGEDDPLGEEDLPSEEDSPREEDPPGEEDLPGEEDLPGEEDLPEVKPKSEEEGSLKLEDLPTVEAPGDPQEPQNNAHRDKEGDDQSHWRYGGDPPWPRVSPACAGRFQSPVDIRPQLAAFCPALRPLELLGFQLPPLPELRLRNNGHSVQLTLPPGLEMALGPGREYRALQLHLHWGAAGRPGSEHTVEGHRFPAEIHVVHLSTAFARVDEALGRPGGLAVLAAFLEEGPEENSAYEQLLSRLEEIAEEGSETQVPGLDISALLPSDFSRYFQYEGSLTTPPCAQGVIWTVFNQTVMLSAKQLHTLSDTLWGPGDSRLQLNFRATQPLNGRVIEASFPAGVDSSPRAAEPVQLNSCLAAGDILALVFGLLFAVTSVAFLVQMRRQHRRGTKGGVSYRPAEVAETGA

SEQ ID NO: 168 - protein, 805 aa, Homo sapiens [sequence omitted]

SEQ ID NO: 169 - protein, 109 aa, Homo sapiens
MKFISTSLLLMLLVSSLSPVQGVLEVYYTSLRCRCVQESSVFIPRRFIDRIQILPRGNGCPRKEIIVWKKNKSIVCVDPQAEWIQRMMEVLRKRSSSTLPVPVFKRKIP

SEQ ID NO: 170 - protein, 680 aa, Homo sapiens
MLPQIPFLLLVSLNLVHGVFYAERYQMPTGIKGPLPNTKTQFFIPYTIKSKGIAVRGEQGTPGPPGPAGPRGHPGPSGPPGKPGYGSPGLQGEPGLPGPPGPSAVGKPGVPGLPGKPGERGPYGPKGDVGPAGLPGPRGPPGPPGIPGPAGISVPGKPGQQGPTGAPGPRGFPGEKGAPGVPGMNGQKGEMGYGAPGRPGERGLPGPQGPTGPSGPPGVGKRGENGVPGQPGIKGDRGFPGEMGPIGPPGPQGPPGERGPEGIGKPGAAGAPGQPGIPGTKGLPGAPGIAGPPGPPGFGKPGLPGLKGERGPAGLPGGPGAKGEQGPAGLPGKPGLTGPPGNMGPQGPKGIPGSHGLPGPKGETGPAGPAGYPGAKGERGSPGSDGKPGYPGKPGLDGPKGNPGLPGPKGDPGVGGPPGLPGPVGPAGAKGMPGHNGEAGPRGAPGIPGTRGPIGPPGIPGFPGSKGDPGSPGPPGPAGIATKGLNGPTGPPGPPGPRGHSGEPGLPGPPGPPGPPGQAVMPEGFIKAGQRPSLSGTPLVSANQGVTGMPVSAFTVILSKAYPAIGTPIPFDKILYNRQQHYDPRTGIFTCQIPGIYYFSYHVHVKGTHVWVGLYKNGTPVMYTYDEYTKGYLDQASGSAIIDLTENDQVWLQLPNAESNGLYSSEYVHSSFSGFLVAPM

SEQ ID NO: 171 - protein, 537 aa, Homo sapiens
MAHCVTLVQLSISCDHLIDKDIGSKSDPLCVLLQDVGGGSWAELGRTERVRNCSSPEFSKTLQLEYRFETVQKLRFGIYDIDNKTPELRDDDFLGGAECSLGQIVSSQVLTLPLMLKPGKPAGRGTITVSAQELKDNRVVTMEVEARNLDKKDFLGKSDPFLEFFRQGDGKWHLVYRSEVIKNNLNPTWKRFSVPVQHFCGGNPSTPIQVQCSDYDSDGSHDLIGTFHTSLAQLQAVPAEFECIHPEKQQKKKSYKNSGTIRVKICRVETEYSFLDYVMGGCQINFTVGVDFTGSNGDPSSPDSLHYLSPTGVNEYLMALWSVGSVVQDYDSDKLFPAFGFGAQVPPDWQVSHEFALNFNPSNPYCAGIQGIVDAYRQALPQVRLYGPTNFAPIINHVARFAAQAAHQGTASQYFMLLLLTDGAVTDVEATREAVVRASNLPMSVIIVGVGGADFEAMEQLDADGGPLHTRSGQAAARDIVQFVPYRRFQNAPREALAQTVLAEVPTQLVSYFRAQGWAPLKPLPPSAKDPAQAPQA

SEQ ID NO: 172 - protein, 635 aa, Homo sapiens; identical to SEQ ID NO: 152

SEQ ID NO: 173 - protein, 184 aa, Homo sapiens
MSRTAYTVGALLLLLGTLLPAAEGKKKGSQGAIPPPDKAQHNDSEQTQSPQQPGSRNRGRGQGRGTAMPGEEVLESSQEALHVTERKYLKRDWCKTQPLKQTIHEEGCNSRTIINRFCYGQCNSFYIPRHIRKEEGSFQSCSFCKPKKFTTMMVTLNCPELQPPTKKKRVTRVKQCRCISIDLD

SEQ ID NO: 174 - protein, 261 aa, Homo sapiens; identical to SEQ ID NO: 155

SEQ ID NO: 175 - protein, 433 aa, Homo sapiens
MRQSHQLPLVGLLLFSFIPSQLCEICEVSEENYIRLKPLLNTMIQSNYNRGTSAVNVVLSLKLVGIQIQTLMQKMIQQIKYNVKSRLSDVSSGELALIILALGVCRNAEENLIYDYHLIDKLENKFQAEIENMEAHNGTPLTNYYQLSLDVLALCLFNGNYSTAEVVNHFTPENKNYYFGSQFSVDTGAMAVLALTCVKKSLINGQIKADEGSLKNISIYTKSLVEKILSEKKENGLIGNTFSTGEAMQALFVSSDYYNENDWNCQQTLNTVLTEISQGAFSNPNAAAQVLPALMGKTFLDINKDSSCVSASGNFNISADEPITVTPPDSQSYISVNYSVRINETYFTNVTVLNGSVFLSVMEKAQKMNDTIFGFTMEERSWGPYITCIQGLCANNNDRTYWELLSGGEPLSQGAGSYVVRNGENLEVRWSKY

SEQ ID NO: 176 - protein, 764 aa, Homo sapiens
MLLFVLTCLLAVFPAISTKSPIFGPEEVNSVEGNSVSITCYYPPTSVNRHTRKYWCRQGARGGCITLISSEGYVSSKYAGRANLTNFPENGTFVVNIAQLSQDDSGRYKCGLGINSRGLSFDVSLEVSQGPGLLNDTKVYTVDLGRTVTINCPFKTENAQKRKSLYKQIGLYPVLVIDSSGYVNPNYTGRIRLDIQGTGQLLFSVVINQLRLSDAGQYLCQAGDDSNSNKKNADLQVLKPEPELVYEDLRGSVTFHCALGPEVANVAKFLCRQSSGENCDVVVNTLGKRAPAFEGRILLNPQDKDGSFSVVITGLRKEDAGRYLCGAHSDGQLQEGSPIQAWQLFVNEESTIPRSPTVVKGVAGGSVAVLCPYNRKESKSIKYWCLWEGAQNGRCPLLVDSEGWVKAQYEGRLSLLEEPGNGTFTVILNQLTSRDAGFYWCLTNGDTLWRTTVEIKIIEGEPNLKVPGNVTAVLGETLKVPCHFPCKFSSYEKYWCKWNNTGCQALPSQDEGPSKAFVNCDENSRLVSLTLNLVTRADEGWYWCGVKQGHFYGETAAVYVAVEERKAAGSRDVSLAKADAAPDEKVLDSGFREIENKAIQDPRLFAEEKAVADTRDQADGSRASVDSGSSEEQGGSSRALVSTLVPLGLVLAVGAVAVGVARARHRKNVDRVSIRSYRTDISMSDFENSREFGANDNMGASSITQETSLGGKEEFVATTESTTETKEPKKAKRSSKEEAEMAYKDFLLQSSTVAAEAQDGPQEA

SEQ ID NO: 177 - protein, 680 aa, Homo sapiens; identical to SEQ ID NO: 170

SEQ ID NO: 178 - protein, 325 aa, Homo sapiens
MALADSTRGLPNGGGGGGGSGSSSSSAEPPLFPDIVELNVGGQVYVTRRCTVVSVPDSLLWRMFTQQQPQELARDSKGRFFLDRDGFLFRYILDYLRDLQLVLPDYFPERSRLQREAEYFELPELVRRLGAPQQPGPGPPPSRRGVHKEGSLGDELLPLGYSEPEQQEGASAGAPSPTLELASRSPSGGAAGPLLTPSQSLDGSRRSGYITIGYRGSYTIGRDAQADAKFRRVARITVCGKTSLAKEVFGDTLNESRDPDRPPERYTSRYYLKFNFLEQAFDKLSESGFHMVACSSTGTCAFASSTDQSEDKIWTSYTEYVFCRE

SEQ ID NO: 179 - protein, 509 aa, Homo sapiens
MGCGCSSHPEDDWMENIDVCENCHYPIVPLDGKGTLLIRNGSEVRDPLVTYEGSNPPASPLQDNLVIALHSYEPSHDGDLGFEKGEQLRILEQSGEWWKAQSLTTGQEGFIPFNFVAKANSLEPEPWFFKNLSRKDAERQLLAPGNTHGSFLIRESESTAGSFSLSVRDFDQNQGEVVKHYKIRNLDNGGFYISPRITFPGLHELVRHYTNASDGLCTRLSRPCQTQKPQKPWWEDEWEVPRETLKLVERLGAGQFGEVWMGYYNGHTKVAVKSLKQGSMSPDAFLAEANLMKQLQHQRLVRLYAVVTQEPIYIITEYMENGSLVDFLKTPSGIKLTINKLLDMAAQIAEGMAFIEERNYIHRDLRAANILVSDTLSCKIADFGLARLIEDNEYTAREGAKFPIKWTAPEAINYGTFTIKSDVWSFGILLTEIVTHGRIPYPGMTNPEVIQNLERGYRMVRPDNCPEELYQLMRLCWKERPEDRPTFDYLRSVLEDFFTATEGQYQPQP

SEQ ID NO: 180 - protein, 317 aa, Homo sapiens
MTSRTRVTWPSPPRPLPVPAAAAVAFGAKGTDPAEARSSRGIEEAGPRAHGRAGREPERRRSRQQRRGGLQARRSTLLKTCARARATAPGAMKMVAPWTRFYSNSCCLCCHVRTGTILLGVWYLIINAVVLLILLSALADPDQYNFSSSELGGDFEFMDDANMCIAIAISLLMILICAMATYGAYKQRAAWIIPFFCYQIFDFALNMLVAITVLIYPNSIQEYIRQLPPNFPYRDDVMSVNPTCLVLIILLFISIILTFKGYLISCVWNCYRYINGRNSSDVLVYVTSNDTTVLLPPYDDATVNGAAKEPPPPYVSA

SEQ ID NO: 181 - protein, 702 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNKLSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 182 - protein, 334 aa, Homo sapiens
MATLKEKLIAPVAEEEATVPNNKITVVGVGQVGMACAISILGKSLADELALVDVLEDKLKGEMMDLQHGSLFLQTPKIVADKDYSVTANSKIVVVTAGVRQQEGESRLNLVQRNVNVFKFIIPQIVKYSPDCIIIVVSNPVDILTYVTWKLSGLPKHRVIGSGCNLDSARFRYLMAEKLGIHPSSCHGWILGEHGDSSVAVWSGVNVAGVSLQELNPEMGTDNDSENWKEVHKMVVESAYEVIKLKGYTNWAIGLSVADLIESMLKNLSRIHPVSTMVKGMYGIENEVFLSLPCILNARGLTSVINQKLKDDEVAQLKKSADTLWDIQKDLKDL

SEQ ID NO: 183 - protein, 119 aa, Homo sapiens
MEASALTSSAVTSVAKVVRVASGSAVVLPLARIATVVIGGVVAVPMVLSAMGFTAAGIASSSIAAKMMSAAAIANGGGVASGSLVATLQSLGATGLSGLTKFILGSIGSAIAAVIARFY

SEQ ID NO: 184 - protein, 987 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEV

SEQ ID NO: 185 - protein, 114 aa, Homo sapiens
MWWSTLMSILRARSFWKWISTQTVRIIRAVRAHFGGIMDEPSPLAQPLELNQHSRFIIGSVSEDNSEDEISNLVKLDLLEEKEGSLSPASVGSDTLSDLGISSLQDGLALHIRL

SEQ ID NO: 186 - protein, 375 aa, Homo sapiens
MERASCLLLLLLPLVHVSATTPEPCELDDEDFRCVCNFSEPQPDWSEAFQCVSAVEVEIHAGGLNLEPFLKRVDADADPRQYADTVKALRVRRLTVGAAQVPAQLLVGALRVLAYSRLKELTLEDLKITGTMPPLPLEATGLALSSLRLRNVSWATGRSWLAELQQWLKPGLKVLSIAQAHSPAFSCEQVRAFPALTSLDLSDNPGLGERGLMAALCPHKFPAIQNLALRNTGMETPTGVCAALAAAGVQPHSLDLSHNSLRATVNPSAPRCMWSSALNSLNLSFAGLEQVPKGLPAKLRVLDLSCNRLNRAPQPDELPEVDNLTLDGNPFLVPGTALPHEGSMNSGVVPACARSTLSVGVSGTLVLLQGARGFA

SEQ ID NO: 187 - protein, 425 aa, Homo sapiens
MNAMLETPELPAVFDGVKLAAVAAVLYVIVRCLNLKSPTAPPDLYFQDSGLSRFLLKSCPLLTKEYIPPLIWGKSGHIQTALYGKMGRVRSPHPYGHRKFITMSDGATSTFDLFEPLAEHCVGDDITMVICPGIANHSEKQYIRTFVDYAQKNGYRCAVLNHLGALPNIELTSPRMFTYGCTWEFGAMVNYIKKTYPLTQLVVVGFSLGGNIVCKYLGETQANQEKVLCCVSVCQGYSALRAQETFMQWDQCRRFYNFLMADNMKKIILSHRQALFGDHVKKPQSLEDTDLSRLYTATSLMQIDDNVMRKFHGYNSLKEYYEEESCMRYLHRIYVPLMLVNAADDPLVHESLLTIPKSLSEKRENVMFVLPLHGGHLGFFEGSVLFPEPLTWMDKLVVEYANAICQWERNKLQCSDTEQVEADLE

SEQ ID NO: 188 - protein, 300 aa, Homo sapiens
MRALEGPGLSLLCLVLALPALLPVPAVRGVAETPTYPWRDAETGERLVCAQCPPGTFVQRPCRRDSPTTCGPCPPRHYTQFWNYLERCRYCNVLCGEREEEARACHATHNRACRCRTGFFAHAGFCLEHASCPPGAGVIAPGTPSQNTQCQPCPPGTFSASSSSSEQCQPHRNCTALGLALNVPGSSSHDTLCTSCTGFPLSTRVPGAEECERAVIDFVAFQDISIKRLQRLLQALEAPEGWGPTPRAGRAALQLKLRRRLTELLGAQDGALLVRLLQALRVARMPGLERSVRERFLPVH

SEQ ID NO: 189 - protein, 184 aa, Homo sapiens; identical to SEQ ID NO: 173

SEQ ID NO: 190 - protein, 805 aa, Homo sapiens [sequence omitted]

SEQ ID NO: 191 - protein, 1499 aa, Homo sapiens
MMANWAEARPLLILIVLLGQFVSIKAQEEDEDEGYGEEIACTQNGQMYLNRDIWKPAPCQICVCDNGAILCDKIECQDVLDCADPVTPPGECCPVCSQTPGGGNTNFGRGRKGQKGEPGLVPVVTGIRGRPGPAGPPGSQGPRGERGPKGRPGPRGPQGIDGEPGVPGQPGAPGPPGHPSHPGPDGLSRPFSAQMAGLDEKSGLGSQVGLMPGSVGPVGPRGPQGLQGQQGGAGPTGPPGEPGDPGPMGPIGSRGPEGPPGKPGEDGEPGRNGNPGEVGFAGSPGARGFPGAPGLPGLKGHRGHKGLEGPKGEVGAPGSKGEAGPTGPMGAMGPLGPRGMPGERGRLGPQGAPGQRGAHGMPGKPGPMGPLGIPGSSGFPGNPGMKGEAGPTGARGPEGPQGQRGETGPPGPVGSPGLPGAIGTDGTPGAKGPTGSPGTSGPPGSAGPPGSPGPQGSTGPQGIRGQPGDPGVPGFKGEAGPKGEPGPHGIQGPIGPPGEEGKRGPRGDPGTVGPPGPVGERGAPGNRGFPGSDGLPGPKGAQGERGPVGSSGPKGSQGDPGRPGEPGLPGARGLTGNPGVQGPEGKLGPLGAPGEDGRPGPPGSIGIRGQPGSMGLPGPKGSSGDPGKPGEAGNAGVPGQRGAPGKDGEVGPSGPVGPPGLAGERGEQGPPGPTGFQGLPGPPGPPGEGGKPGDQGVPGDPGAVGPLGPRGERGNPGERGEPGITGLPGEKGMAGGHGPDGPKGSPGPSGTPGDTGPPGLQGMPGERGIAGTPGPKGDRGGIGEKGAEGTAGNDGARGLPGPLGPPGPAGPTGEKGEPGPRGLVGPPGSRGNPGSRGENGPTGAVGFAGPQGPDGQPGVKGEPGEPGQKGDAGSPGPQGLAGSPGPHGPNGVPGLKGGRGTQGPPGATGFPGSAGRVGPPGPAGAPGPAGPLGEPGKEGPPGLRGDPGSHGRVGDRGPAGPPGGPGDKGDPGEDGQPGPDGPPGPAGTTGQRGIVGMPGQRGERGMPGLPGPAGTPGKVGPTGATGDKGPPGPVGPPGSNGPVGEPGPEGPAGNDGTPGRDGAVGERGDRGDPGPAGLPGSQGAPGTPGPVGAPGDAGQRGDPGSRGPIGPPGRAGKRGLPGPQGPRGDKGDHGDRGDRGQKGHRGFTGLQGLPGPPGPNGEQGSAGIPGPFGPRGPPGPVGPSGKEGNPGPLGPIGPPGVRGSVGEAGPEGPPGEPGPPGPPGPPGHLTAALGDIMGHYDESMPDPLPEFTEDQAAPDDKNKTDPGVHATLKSLSSQIETMRSPDGSKKHPARTCDDLKLCHSAKQSGEYWIDPNQGSVEDAIKVYCNMETGETCISANPSSVPRKTWWASKSPDNKPVWYGLDMNRGSQFAYGDHQSPNTAITQMTFLRLLSKEASQNITYICKNSVGYMDDQAKNLKKAVVLKGANDLDIKAEGNIRFRYIVLQDTCSKRNGNVGKTVFEYRTQNVARLPIIDLAPVDVGGTDQEFGVEIGPVCFV

SEQ ID NO: 192 - protein, 125 aa, Homo sapiens
MKKSGVLFLLGIILLVLIGVQGTPVVRKGRCSCISTNQGTIHLQSLKDLKQFAPSPSCEKIEIIATLKNGVQTCLNPDSADVKELIKKWEKQVSQKKKQKNGKKHQKKKVLKVRKSQRSRQKKTT

SEQ ID NO: 193 - protein, 235 aa, Homo sapiens
MNSYFTNPSLSCHLAGGQDVLPNVALNSTAYDPVRHFSTYGAAVAQNRIYSTPFYSPQENVVFSSSRGPYDYGSNSFYQEKDMLSNCRQNTLGHNTQTSIAQDFSSEQGRTAPQDQKASIQIYPWMQRMNSHSGVGYGADRRRGRQIYSRYQTLELEKEFHFNRYLTRRRRIEIANALCLTERQIKIWFQNRRMKWKKESNLTSTLSGGGGGATADSLGGKEEKREETEEEKQKE

SEQ ID NO: 194 - protein, 1178 aa, Homo sapiens
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 195 - protein, 469 aa, Homo sapiens
MHSFPPLLLLLFWGVVSHSFPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 196 - protein, 1194 aa, Homo sapiens
MAKPYEFNWQKEVPSFLQEGTVFDRYEEESFVFEPNCLFKVDEFGFFLTWRSEGKEGQVLECSLINSIRSGAIPKDPKILAALEAVGKSENDLEGRIVCVCSGTDLVNISFTYMVAENPEVTKQWVEGLRSIIHNFRANNVSPMTCLKKHWMKLAFMTNTNGKIPVRSITRTFASGKTEKVIFQALKELGLPSGKNDEIEPTAFSYEKFYELTQKICPRTDIEDLFKKINGDKTDYLTVDQLVSFLNEHQRDPRLNEILFPFYDAKRAMQIIEMYEPDEDLKKKGLISSDGFCRYLMSDENAPVFLDRLELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQQYKMSKYCEDLFGDLLLKQALESHPLEPGRALPSPNDLKRKILIKNKRLKPEVEKKQLEALRSMMEAGESASPANILEDDNEEEIESADQEEEAHPEFKFGNELSADDLGHKEAVANSVKKGLVTVEDEQAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNAGCQMVSLNYQTPDLAMQLNQGKFEYNGSCGYLLKPDFMRRPDRTFDPFSETPVDGVIAATCSVQVISGQFLSDKKIGTYVEVDMYGLPTDTIRKEFRTRMVMNNGLNPVYNEESFVFRKVILPDLAVLRIAVYDDNNKLIGQRILPLDGLQAGYRHISLRNEGNKPLSLPTIFCNIVLKTYVPDGFGDIVDALSDPKKFLSITEKRADQMRAMGIETSDIADVPSDTSKNDKKGKANTAKANVTPQSSSELRPTTTAALASGVEAKKGIELIPQVRIEDLKQMKAYLKHLKKQQKELNSLKKKHAKEHSTMQKLHCTQVDKIVAQYDKEKSTHEKILEKAMKKKGGSNCLEMKKETEIKIQTLTSDHKSKVKEIVAQHTKEWSEMINTHSAEEQEIRDLHLSQQCELLKKLLINAHEQQTQQLKLSHDRESKEMRAHQAKISMENSKAISQDKSIKNKAERERRVRELNSSNTKKFLEERKRLAMKQSKEMDQLKKVQLEHLEFLEKQNEQLLKSCHAVSQTQGEGDAADGEIGSRDGPQTSNSSMKLQNAN

SEQ ID NO: 197 - protein, 1912 aa, Homo sapiens
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSESIGGTPIRGALQIEQSEESDQGKYECVATNSAGTRYSAPANLYVRELREVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSKPSAPPQDISCTSPSSTSILVSWQPPPVEKQNGIITEYSIKYTAVDGEDDKPHEILGIPSDTTKYLLEQLEKWTEYRITVTAHTDVGPGPESLSVLIRTNEDVPSGPPRKVEVEAVNSTSVKVSWRSPVPNKQHGQIRGYQVHYVRMENGEPKGQPMLKDVMLADAQWEFDDTTEHDMIISGLQPETSYSLTVTAYTTKGDGARSKPKLVSTTGAVPGKPRLVINHTQMNTALIQWHPPVDTFGPLQGYRLKFGRKDMEPLTTLEFSEKEDHFTATDIHKGASYVFRLSARNKVGFGEEMVKEISIPEEVPTGFPQNLHSEGTTSTSVQLSWQPPVLAERNGIITKYTLLYRDINIPLLPMEQLIVPADTTMTLTGLKPDTTYDVKVRAHTSKGPGPYSPSVQFRTLPVDQVFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKRKRAESDSRKSSIPNNKEIPSHHPTDPVELRRLNFQTPGMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFKNRLVNIMPYESTRVCLQPIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 198 - protein, 336 aa, Homo sapiens
MLQSLAGSSCVRLVERHRSAWCFGFLVLGYLLYLVFGAVVFSSVELPYEDLLRQELRKLKRRFLEEHECLSEQQLEQFLGRVLEASNYGVSVLSNASGNWNWDFTSALFFASTVLSTTGYGHTVPLSDGGKAFCIIYSVIGIPFTLLFLTAVVQRITVHVTRRPVLYFHIRWGFSKQVVAIVHAVLLGFVTVSCFFFIPAAVFSVLEDDWNFLESFYFCFISLSTIGLGDYVPGEGYNQKFRELYKIGITCYLLLGLIAMLVVLETFCELHELKKFRKMFYVKKDKDEDQVHIIEHDQLSFSSITDQAAGMKEDQKQNEPFVATQSSACVDGPANH

SEQ ID NO: 199 - protein, 674 aa, Homo sapiens
MPSYTVTVATGSQWFAGTDDYIYLSLVGSAGCSEKHLLDKPFYNDFERGAVDSYDVTVDEELGEIQLVRIEKRKYWLNDDWYLKYITLKTPHGDYIEFPCYRWITGDVEVVLRDGRAKLARDDQIHILKQHRRKELETRQKQYRWMEWNPGFPLSIDAKCHKDLPRDIQFDSEKGVDFVLNYSKAMENLFINRFMHMFQSSWNDFADFEKIFVKISNTISERVMNHWQEDLMFGYQFLNGCNPVLIRRCTELPEKLPVTTEMVECSLERQLSLEQEVQQGNIFIVDFELLDGIDANKTDPCTLQFLAAPICLLYKNLANKIVPIAIQLNQIPGDENPIFLPSDAKYDWLLAKIWVRSSDFHVHQTITHLLRTHLVSEVFGIAMYRQLPAVHPIFKLLVAHVRFTIAINTKAREQLICECGLFDKANATGGGGHVQMVQRAMKDLTYASLCFPEAIKARGMESKEDIPYYFYRDDGLLVWEAIRTFTAEVVDIYYEGDQVVEEDPELQDFVNDVYVYGMRGRKSSGFPKSVKSREQLSEYLTVVIFTASAQHAAVNFGQYDWCSWIPNAPPTMRAPPPTAKGVVTIEQIVDTLPDRGRSCWHLGAVWALSQFQENELFLGMYPEEHFIEKPVKEAMARFRKNLEAIVSVIAERNKKKQLPYYYLSPDRIPNSVAI

SEQ ID NO: 200 - protein, 98 aa, Homo sapiens
MNQTAILICCLIFLTLSGIQGVPLSRTVRCTCISISNQPVNPRSLEKLEIIPASQFCPRVEIIATMKKKGEKRCLNPESKAIKNLLKAVSKEMSKRSP

SEQ ID NO: 201 - protein, 492 aa, Homo sapiens
MALNSGSPPAIGPYYENHGYQPENPYPAQPTVVPTVYEVHPAQYYPSPVPQYAPRVLTQASNPVVCTQPKSPSGTVCTSKTKKALCITLTLGTFLVGAALAAGLLWKFMGSKCSNSGIECDSSGTCINPSNWCDGVSHCPGGEDENRCVRLYGPNFILQMYSSQRKSWHPVCQDDWNENYGRAACRDMGYKNNFYSSQGIVDDSGSTSFMKLNTSAGNVDIYKKLYHSDACSSKAVVSLRCIACGVNLNSSRQSRIVGGESALPGAWPWQVSLHVQNVHVCGGSIITPEWIVTAAHCVEKPLNNPWHWTAFAGILRQSFMFYGAGYQVEKVISHPNYDSKTKNNDIALMKLQKPLTFNDLVKPVCLPNPGMMLQPEQLCWISGWGATEEKGKTSEVLNAAKVLLIETQRCNSRYVYDNLITPAMICAGFLQGNVDSCQGDSGGPLVTSKNNIWWLIGDTSWGSGCAKAYRPGVYGNVMVFTDWIYRQMRADG

SEQ ID NO: 202 - protein, 158 aa, Homo sapiens
MMQKLLKCSRLVLALALILVLESSVQGYPTRRARYQWVRCNPDSNSANCLEEKGPMFELLPGESNKIPRLRTDLFPKTRIQDLNRIFPLSEDYSGSGFGSGSGSGSGSGSGFLTEMEQDYQLVDESDAFHDNLRSLDRNLPSDSQDLGQHGLEEDFML

SEQ ID NO: 203 - protein, 255 aa, Homo sapiens
MILNKALLLGALALTTVMSPCGGEDIVADHVASCGVNLYQFYGPSGQYTHEFDGDEQFYVDLERKETAWRWPEFSKFGGFDPQGALRNMAVAKHNLNIMIKRYNSTAATNEVPEVTVFSKSPVTLGQPNTLICLVDNIFPPVVNITWLSNGQSVTEGVSETSFLSKSDHSFFKISYLTFLPSADEIYDCKVEHWGLDQPLLKHWEPEIPAPMSELTETVVCALGLSVGLMGIVVGTVFIIQGLRSVGASRHQGPL

SEQ ID NO: 204 - protein, 598 aa, Homo sapiens
MPCVQAQYGSSPQGASPASQSYSYHSSGEYSSDFLTPEFVKFSMDLTNTEITATTSLPSFSTFMDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTPVSRLSLFSFKQSPPGTPVSSCQMRFDGPLHVPMNPEPAGSHHVVDGQTFAVPNPIRKPASMGFPGLQIGHASQLLDTQVPSPPSRGSPSNEGLCAVCGDNAACQHYGVRTCEGCKGFFKRTVQKNAKYVCLANKNCPVDKRRRNRCQYCRFQKCLAVGMVKEVVRTDSLKGRRGRLPSKPKSPQEPSPPSPPVSLISALVRAHVDSNPAMTSLDYSRFQANPDYQMSGDDTQHIQQFYDLLTGSMEIIRGWAEKIPGFADLPKADQDLLFESAFLELFVLRLAYRSNPVEGKLIFCNGVVLHRLQCVRGFGEWIDSIVEFSSNLQNMNIDISAFSCIAALAMVTERHGLKEPKRVEELQNKIVNCLKDHVTFNNGGLNRPNYLSKLLGKLPELRTLCTQGLQRIFYLKLEDLVPPPAIIDKLFLDTLPF

SEQ ID NO: 205 - protein, 325 aa, Homo sapiens; identical to SEQ ID NO: 178

SEQ ID NO: 206 - protein, 164 aa, Homo sapiens
MASPHQEPKPGDLIEIFRLGYEHWALYIGDGYVIHLAPPSEYPGAGSSSVFSVLSNSAEVKRGRLEDVVGGCCYRVNNSLDHEYQPRPVEVIISSAKEMVGQKMKYSIVSRNCEHFVAQLRYGKSRCKQVEKAKVEVGVATALGILVVAGCSFAIRRYQKKATA

SEQ ID NO: 207 - protein, 334 aa, Homo sapiens; identical to SEQ ID NO: 182

SEQ ID NO: 208 - protein, 149 aa, Homo sapiens
MMTKHKKCFIIVGVLITTNIITLIVKLTRDSQSLCPYDWIGFQNKCYYFSKEEGDWNSSKYNCSTQHADLTIIDNIEEMNFLRRYKCSSDHWIGLKMAKNRTGQWVDGATFTKSFGMRGSEGCAYLSDDGAATARCYTERKWICRKRIH

SEQ ID NO: 209 - protein, 2647 aa, Homo sapiens
MSSSHSRAGQSAAGAAPGGGVDTRDAEMPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVTNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGTGEVEVVIQDPMGQKGTVEPQLEARGDSTYRCSYQPTMEGVHTVHVTFAGVPIPRSPYTVTVGQACNPSACRAVGRGLQPKGVRVKETADFKVYTKGAGSGELKVTVKGPKGEERVKQKDLGDGVYGFEYYPMVPGTYIVTITWGGQNIGRSPFEVKVGTECGNQKVRAWGPGLEGGVVGKSADFVVEAIGDDVGTLGFSVEGPSQAKIECDDKGDGSCDVRYWPQEAGEYAVHVLCNSEDIRLSPFMADIRDAPQDFHPDRVKARGPGLEKTGVAVNKPAEFTVDAKHGGKAPLRVQVQDNEGCPVEALVKDNGNGTYSCSYVPRKPVKHTAMVSWGGVSIPNSPFRVNVGAGSHPNKVKVYGPGVAKTGLKAHEPTYFTVDCAEAGQGDVSIGIKCAPGVVGPAEADIDFDIIRNDNDTFTVKYTPRGAGSYTIMVLFADQATPTSPIRVKVEPSHDASKVKAEGPGLSRTGVELGKPTHFTVNAKAAGKGKLDVQFSGLTKGDAVRDVDIIDHHDNTYTVKYTPVQQGPVGVNVTYGGDPIPKSPFSVAVSPSLDLSKIKVSGLGEKVDVGKDQEFTVKSKGAGGQGKVASKIVGPSGAAVPCKVEPGLGADNSVVRFLPREEGPYEVEVTYDGVPVPGSPFPLEAVAPTKPSKVKAFGPGLQGGSAGSPARFTIDTKGAGTGGLGLTVEGPCEAQLECLDNGDGTCSVSYVPTEPGDYNINILFADTHIPGSPFKAHVVPCFDASKVKCSGPGLERATAGEVGQFQVDCSSAGSAELTIEICSEAGLPAEVYIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTETYVQDRGDGMYKVEYTPYEEGLHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGLVEPVDVVDNADGTQTVNYVPSREGPYSISVLYGDEEVPRSPFKVKVLPTHDASKVKASGPGLNTTGVPASLPVEFTIDAKDAGEGLLAVQITDPEGKPKKTHIQDNHDGTYTVAYVPDVTGRYTILIKYGGDEIPFSPYRVRAVPTGDASKCTVTVSIGGHGLGAGIGPTIQIGEETVITVDTKAAGKGKVTCTVCTPDGSEVDVDVVENEDGTFDIFYTAPQPGKYVICVRFGGEHVPNSPFQVTALAGDQPSVQPPLRSQQLAPQYTYAQGGQQTWAPERPLVGVNGLDVTSLRPFDLVIPFTIKKGEITGEVRMPSGKVAQPTITDNKDGTVTVRYAPSEAGLHEMDIRYDNMHIPGSPLQFYVDYVNCGHVTAYGPGLTHGVVNKPATFTVNTKDAGEGGLSLAIEGPSKAEISCTDNQDGTCSVSYLPVLPGDYSILVKYNEQHVPGSPFTARVTGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANVGSHCDLSLKIPEISIQDMTAQVTSPSGKTHEAEIVEGENHTYCIRFVPAEMGTHTVSVKYKGQHVPGSPFQFTVGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGVYLIDVKFNGTHIPGSPFKIRVGEPGHGGDPGLVSAYGAGLEGGVTGNPAEFVVNTSNAGAGALSVTIDGPSKVKMDCQECPEGYRVTYTPMAPGSYLISIKYGGPYHIGGSPFKAKVTGPRLVSNHSLHETSSVFVDSLTKATCAPQHGAPGPGPADASKVVAKGLGLSKAYVGQKSSFTVDCSKAGNNMLLVGVHGPRTPCEEILVKHVGSRLYSVSYLLKDKGEYTLVVKWGHEHIPGSPYRVVVP

SEQ ID NO: 210 - protein, 114 aa, Homo sapiens
MSLLSSRAARVPGPSSSLCALLVLLLLLTQPGPIASAGPAAAVLRELRCVCLQTTQGVHPKMISNLQVFAIGPQCSKVEVVASLKNGKEICLDPEAPFLKKVIQKILDGGNKEN

SEQ ID NO: 211 - protein, 1158 aa, Homo sapiens
MAAVRGAPLLSCLLALLALCPGGRPQTVLTDDEIEEFLEGFLSELEPEPREDDVEAPPPPEPTPRVRKAQAGGKPGKRPGTAAEVPPEKTKDKGKKGKKDKGPKVPKESLEGSPRPPKKGKEKPPKATKKPKEKPPKATKKPKEKPPKATKKPKEKPPKATKKPPSGKRPPILAPSETLEWPLPPPPSPGPEELPQEGGAPLSNNWQNPGEETHVEAREHQPEPEEETEQPTLDYNDQIEREDYEDFEYIRRQKQPRPPPSRRRRPERVWPEPPEEKAPAPAPEERIEPPVKPLLPPLPPDYGDGYVIPNYDDMDYYFGPPPPQKPDAERQTDEEKEELKKPKKEDSSPKEETDKWAVEKGKDHKEPRKGEELEEEWTPTEKVKCPPIGMESHRIEDNQIRASSMLRHGLGAQRGRLNMQTGATEDDYYDGAWCAEDDARTQWIEVDTRRTTRFTGVITQGRDSSIHDDFVTTFFVGFSNDSQTWVMYTNGYEEMTFHGNVDKDTPVLSELPEPVVARFIRIYPLTWNGSLCMRLEVLGCSVAPVYSYYAQNEVVATDDLDFRHHSYKDMRQLMKVVNEECPTITRTYSLGKSSRGLKIYAMEISDNPGEHELGEPEFRYTAGIHGNEVLGRELLLLLMQYLCREYRDGNPRVRSLVQDTRIHLVPSLNPDGYEVAAQMGSEFGNWALGLWTEEGFDIFEDFPDLNSVLWGAEERKWVPYRVPNNNLPIPERYLSPDATVSTEVRAIIAWMEKNPFVLGANLNGGERLVSYPYDMARTPTQEQLLAAAMAAARGEDEDEVSEAQETPDHAIFRWLAISFASAHLTLTEPYRGGCQAQDYTGGMGIVNGAKWNPRTGTINDFSYLHTNCLELSFYLGCDKFPHESELPREWENNKEALLTFMEQVHRGIKGVVTDEQGIPIANATISVSGINHGVKTASGGDYWRILNPGEYRVTAHAEGYTPSAKTCNVDYDIGATQCNFILARSNWKRIREIMAMNGNRPIPHIDPSRPMTPQQRRLQQRRLQHRLRLRAQMRLRRLNATTTLGPHTVPPTLPPAPATTLSTTIEPWGLIPPTTAGWEESETETYTEVVTEFGTEVEPEFGTKVEPEFETQLEPEFETQLEPEFEEEEEEEKEEEIATGQAFPFTTVETYTVNFGDF

SEQ ID NO: 212 - protein, 368 aa, Homo sapiens
MWPLWRLVSLLALSQALPFEQRGFWDFTLDDGPFMMNDEEASGADTSGVLDPDSVTPTYSAMCPFGCHCHLRVVQCSDLGLKSVPKEISPDTTLLDLQNNDISELRKDDFKGLQHLYALVLVNNKISKIHEKAFSPLRKLQKLYISKNHLVEIPPNLPSSLVELRIHDNRIRKVPKGVFSGLRNMNCIEMGGNPLENSGFEPGAFDGLKLNYLRISEAKLTGIPKDLPETLNELHLDHNKIQAIELEDLLRYSKLYRLGLGHNQIRMIENGSLSFLPTLRELHLDNNKLARVPSGLPDLKLLQVVYLHSNNITKVGVNDFCPMGFGVKRAYYNGISLFNNPVPYWEVQPATFRCVTDRLAIQFGNYKK

SEQ ID NO: 213 - protein, 871 aa, Homo sapiens
MKYSCCALVLAVLGTELLGSLCSTVRSPRFRGRIQQERKNIRPNIILVPTDDQDVELGSLQVMNKTRKIMEHGGATFINAFVTTPMCCPSRSSMLTGKYVHNHNVYTNNENCSSPSWQAMHEPRTFAVYLNNTGYRTAFFGKYLNEYNGSYIPPGWREWLGLIKNSRFYNYTVCRNGIKEKHGFDYAKDYFTDLITNESINYFKMSKRMYPHRPVMMVISHAAPHGPEDSAPQFSKLYPNASQHITPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRFRTNKKAKIWRDTFLVERGKFLRKKEESSKNIQQSNHLPKYERVKELCQQARYQTACEQPGQKWQCIEDTSGKLRIHKCKGPSDLLTVRQSTRNLYARGFHDKDKECSCRESGYRASRSQRKSQRQFLRNQGTPKYKPRFVHTRQTRSLSVEFEGEIYDINLEEEEELQVLQPRNIAKRHDEGHKGPRDLQASSGGNRGRMLADSSNAVGPPTTVRVTHKCFILPNDSIHCERELYQSARAWKDHKAYIDKEIEALQDKIKNLREVRGHLKRRKPEECSCSKQSYYNKEKGVKKQEKLKSHLHPFKEAAQEVDSKLQLFKENNRRRKKERKEKRRQRKGEECSLPGLTCFTHDNNHWQTAPFWNLGSFCACTSSNNNTYWCLRTVNETHNFLFCEFATGFLEYFDMNTDPYQLTNTVHTVERGILNQLHVQLMELRSCQGYKQCNPRPKNLDVGNKDGGSYDLHRGQLWDGWEG

SEQ ID NO: 214 - protein, 1019 aa, Homo sapiens
MLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEINQDTINRIIKVMKHEAYGECYKVSCLEIPGPSGPKGYRGQKGAKGNMGEPGEPGQKGRQGDPGIEGPIGFPGPKGVPGFKGEKGEFGADGRKGAPGLAGKNGTDGQKGKLGRIGPPGCKGDPGNRGPDGYPGEAGSPGERGDQGGKGDPGRPGRRGPPGEIGAKGSKGYQGNNGAPGSPGVKGAKGGPGPRGPKGEPGRRGDPGTKGSPGSDGPKGEKGDPGPEGPRGLAGEVGNKGAKGDRGLPGPRGPQGALGEPGKQGSRGDPGDAGPRGDSGQPGPKGDPGRPGFSYPGPRGAPGEKGEPGPRGPEGGRGDFGLKGEPGRKGEKGEPADPGPPGEPGPRGPRGVPGPEGEPGPPGDPGLTECDVMTYVRETCGCCDCEKRCGALDVVFVIDSSESIGYTNFTLEKNFVINVVNRLGAIAKDPKSETGTRVGVVQYSHEGTFEAIQLDDEHIDSLSSFKEAVKNLEWIAGGTWTPSALKFAYDRLIKESRRQKTRVFAVVITDGRHDPRDDDLNLRALCDRDVTVTAIGIGDMFHEKHESENLYSIACDKPQQVRNMTLFSDLVAEKFIDDMEDVLCPDPQIVCPDLPCQTELSVAQCTQRPVDIVFLLDGSERLGEQNFHKARRFVEQVARRLTLARRDDDPLNARVALLQFGGPGEQQVAFPLSHNLTAIHEALETTQYLNSFSHVGAGVVHAINAIVRSPRGGARRHAELSFVFLTDGVTGNDSLHESAHSMRKQNVVPTVLALGSDVDMDVLTTLSLGDRAAVFHEKDYDSLAQPGFFDRFIRWIC

SEQ ID NO: 215 - protein, 1172 aa, Homo sapiens
MVWRLVLLALWVWPSTQAGHQDKDTTFDLFSISNINRKTIGAKQFRGPDPGVPAYRFVRFDYIPPVNADDLSKITKIMRQKEGFFLTAQLKQDGKSRGTLLALEGPGLSQRQFEIVSNGPADTLDLTYWIDGTRHVVSLEDVGLADSQWKNVTVQVAGETYSLHVGCDLIDSFALDEPFYEHLQAEKSRMYVAKGSARESHFRGLLQNVHLVFENSVEDILSKKGCQQGQGAEINAISENTETLRLGPHVTTEYVGPSSERRPEVCERSCEELGNMVQELSGLHVLVNQLSENLKRVSNDNQFLWELIGGPPKTRNMSACWQDGRFFAENETWVVDSCTTCTCKKFKTICHQITCPPATCASPSFVEGECCPSCLHSVDGEEGWSPWAEWTQCSVTCGSGTQQRGRSCDVTSNTCLGPSIQTRACSLSKCDTRIRQDGGWSHWSPWSSCSVTCGVGNITRIRLCNSPVPQMGGKNCKGSGRETKACQGAPCPIDGRWSPWSPWSACTVTCAGGIRERTRVCNSPEPQYGGKACVGDVQERQMCNKRSCPVDGCLSNPCFPGAQCSSFPDGSWSCGSCPVGFLGNGTHCEDLDECALVPDICFSTSKVPRCVNTQPGFHCLPCPPRYRGNQPVGVGLEAAKTEKQVCEPENPCKDKTHNCHKHAECIYLGHFSDPMYKCECQTGYAGDGLICGEDSDLDGWPNLNLVCATNATYHCIKDNCPHLPNSGQEDFDKDGIGDACDDDDDNDGVTDEKDNCQLLFNPRQADYDKDEVGDRCDNCPYVHNPAQIDTDNNGEGDACSVDIDGDDVFNERDNCPYVYNTDQRDTDGDGVGDHCDNCPLVHNPDQTDVDNDLVGDQCDNNEDIDDDGHQNNQDNCPYISNANQADHDRDGQGDACDPDDDNDGVPDDRDNCRLVFNPDQEDLDGDGRGDICKDDFDNDNIPDIDDVCPENNAISETDFRNFQMVPLDPKGTTQIDPNWVIRHQGKELVQTANSDPGIAVGFDEFGSVDFSGTFYVNTDRDDDYAGFVFGYQSSSRFYVVMWKQVTQTYWEDQPTRAYGYSGVSLKVVNSTTGTGEHLRNALWHTGNTPGQVRTLWHDPRNIGWKDYTAYRWHLTHRPKTGYIRVLVHEGKQVMADSGPIYDQTYAGGRLGLFVFSQEMVYFSDLKYECRDI

SEQ ID NO: 216 - protein, 1194 aa, Homo sapiens; identical to SEQ ID NO: 196

SEQ ID NO: 217 - protein, 538 aa, Homo sapiens
MDDFERRRELRRQKREEMRLEAERIAYQRNDDDEEEAARERRRRARQERLRQKQEEESLGQVTDQVEVNAQNSVPDEEAKTTTTNTQVEGDDEAAFLERLARREERRQKRLQEALERQKEFDPTITDASLSLPSRRMQNDTAENETTEKEEKSESRQERYEIEETETVTKSYQKNDWRDAEENKKEDKEKEEEEEEKPKRGSIGENQIKDEKIKKDKEPKEEVKSFMDRKKGFTEVKSQNGEFMTHKLKHTENTFSRPGGRASVDTKEAEGAPQVEAGKRLEELRRRRGETESEEFEKLKQKQQEAALELEELKKKREERRKVLEEEEQRRKQEEADRKLREEEEKRRLKEEIERRRAEAAEKRQKMPEDGLSDDKKPFKCFTPKGSSLKIEERAEFLNKSVQKSSGVKSTHQAAIVSKIDSRLEQYTSAIEGTKSAKPTKPAASDLPVPAEGVRNIKSMWEKGNVFSSPTAAGTPNKETAGLKVGVSSRINEWLTKTPDGNKSPAPKPSDLRPGDVSSKRNLWEKQSVDKVTSPTKV

SEQ ID NO: 218 - protein, 111 aa, Homo sapiens
MANIHQENEEMEQPMQNGEEDRPLGGGEGHQPAGNRRGQARRLAPNFRWAIPNRQINDGMGGDGDDMEIFMEEMREIRRKLRELQLRNCLRILMGELSNHHDHHDEFCLMP

SEQ ID NO: 219 - protein, 729 aa, Homo sapiens
MGKKYKNIVLLKGLEVINDYHFRMVKSLLSNDLKLNLKMREEYDKIQIADLMEEKFRGDAGLGKLIKIFEDIPTLEDLAETLKKEKLKVKGPALSRKRKKEVDATSPAPSTSSTVKTEGAEATPGAQKRKKSTKEKAGPKGSKVSEEQTQPPSPAGAGMSTAMGRSPSPKTSLSAPPNSSSTENPKTVAKCQVTPRRNVLQKRPVIVKVLSTTKPFEYETPEMEKKIMFHATVATQTQFFHVKVLNTSLKEKFNGKKIIIISDYLEYDSLLEVNEESTVSEAGPNQTFEVPNKIINRAKETLKIDILHKQASGNIVYGVFMLHKKTVNQKTTIYEIQDDRGKMDVVGTGQCHNIPCEEGDKLQLFCFRLRKKNQMSKLISEMHSFIQIKKKTNPRNNDPKSMKLPQEQRQLPYPSEASTTFPESHLRTPQMPPTTPSSSFFTKKSEDTISKMNDFMRMQILKEGSHFPGPFMTSIGPAESHPHTPQMPPSTPSSSFLTTLKPRLKTEPEEVSIEDSAQSDLKEVMVLNATESFVYEPKEQKKMFHATVATENEVFRVKVFNIDLKEKFTPKKIIAIANYVCRNGFLEVYPFTLVADVNADRNMEIPKGLIRSASVTPKINQLCSQTKGSFVNGVFEVHKKNVRGEFTYYEIQDNTGKMEVVVHGRLTTINCEEGDKLKLTCFELAPKSGNTGELRSVIHSHIKVIKTRKNKKDILNPDSSMETSPDFFF

SEQ ID NO: 220 - protein, 195 aa, Homo sapiens
MMAIRELKVCLLGDTGVGKSSIVCRFVQDHFDHNISPTIGASFMTKTVPCGNELHKFLIWDTAGQERFHSLAPMYYRGSAAAVIVYDITKQDSFYTLKKWVKELKEHGPENIVMAIAGNKCDLSDIREVPLKDAKEYAESIGAIVVETSAKNAINIEELFQGISRQIPPLDPHENGNNGTIKVEKPTMQASRRCC

SEQ ID NO: 221 - protein, 1838 aa, Homo sapiens
MDVHTRWKARSALRPGAPLLPPLLLLLLWAPPPSRAAQPADLLKVLDFHNLPDGITKTTGFCATRRSSKGPDVAYRVTKDAQLSAPTKQLYPASAFPEDFSILTTVKAKKGSQAFLVSIYNEQGIQQIGLELGRSPVFLYEDHTGKPGPEDYPLFRGINLSDGKWHRIALSVHKKNVTLILDCKKKTTKFLDRSDHPMIDINGIIVFGTRILDEEVFEGDIQQLLFVSDHRAAYDYCEHYSPDCDTAVPDTPQSQDPNPDEYYTEGDGEGETYYYEYPYYEDPEDLGKEPTPSKKPVEAAKETTEVPEELTPTPTEAAPMPETSEGAGKEEDVGIGDYDYVPSEDYYTPSPYDDLTYGEGEENPDQPTDPGAGAEIPTSTADTSNSSNPAPPPGEGADDLEGEFTEETIRNLDENYYDPYYDPTSSPSEIGPGMPANQDTIYEGIGGPRGEKGQKGEPAIIEPGMLIEGPPGPEGPAGLPGPPGTMGPTGQVGDPGERGPPGRPGLPGADGLPGPPGTMLMLPFRFGGGGDAGSKGPMVSAQESQAQAILQQARLALRGPAGPMGLTGRPGPVGPPGSGGLKGEPGDVGPQGPRGVQGPPGPAGKPGRRGRAGSDGARGMPGQTGPKGDRGFDGLAGLPGEKGHRGDPGPSGPPGPPGDDGERGDDGEVGPRGLPGEPGPRGLLGPKGPPGPPGPPGVTGMDGQPGPKGNVGPQGEPGPPGQQGNPGAQGLPGPQGAIGPPGEKGPLGKPGLPGMPGADGPPGHPGKEGPPGEKGGQGPPGPQGPIGYPGPRGVKGADGIRGLKGTKGEKGEDGFPGFKGDMGIKGDRGEIGPPGPRGEDGPEGPKGRGGPNGDPGPLGPPGEKGKLGVPGLPGYPGRQGPKGSIGFPGFPGANGEKGGRGTPGKPGPRGQRGPTGPRGERGPRGITGKPGPKGNSGGDGPAGPPGERGPNGPQGPTGFPGPKGPPGPPGKDGLPGHPGQRGETGFQGKTGPPGPPGVVGPQGPTGETGPMGERGHPGPPGPPGEQGLPGLAGKEGTKGDPGPAGLPGKDGPPGLRGFPGDRGLPGPVGALGLKGNEGPPGPPGPAGSPGERGPAGAAGPIGIPGRPGPQGPPGPAGEKGAPGEKGPQGPAGRDGLQGPVGLPGPAGPVGPPGEDGDKGEIGEPGQKGSKGDKGEQGPPGPTGPQGPIGQPGPSGADGEPGPRGQQGLFGQKGDEGPRGFPGPPGPVGLQGLPGPPGEKGETGDVGQMGPPGPPGPRGPSGAPGADGPQGPPGGIGNPGAVGEKGEPGEAGEPGLPGEGGPPGPKGERGEKGESGPSGAAGPPGPKGPPGDDGPKGSPGPVGFPGDPGPPGEPGPAGQDGPPGDKGDDGEPGQTGSPGPTGEPGPSGPPGKRGPPGPAGPEGRQGEKGAKGEAGLEGPPGKTGPIGPQGAPGKPGPDGLRGIPGPVGEQGLPGSPGPDGPPGPMGPPGLPGLKGDSGPKGEKGHPGLIGLIGPPGEQGEKGDRGLPGPQGSSGPKGEQGITGPSGPIGPPGPPGLPGPPGPKGAKGSSGPTGPKGEAGHPGPPGPPGPPGEVIQPLPIQASRTRRNIDASQLLDDGNGENYVDYADGMEEIFGSLNSLKLEIEQMKRPLGTQQNPARTCKDLQLCHPDFPDGEYWVDPNQGCSRDSFKVYCNFTAGGSTCVFPDKKSEGARITSWPKENPGSWFSEFKRGKLLSYVDAEGNPVGVVQMTFLRLLSASAHQNVTYHCYQSVAWQDAATGSYDKALRFLGSNDEEMSYDNNPYIRALVDGCATKKGYQKTVLEIDTPKVEQVPIVDIMFNDFGEASQKFGFEVGPACFMG

SEQ ID NO: 222 - protein, 276 aa, Homo sapiens
MRAPHLHLSAASGARALAKLLPLLMAQLWAAEAALLPQNDTRLDPEAYGSPCARGSQPWQVSLFNGLSFHCAGVLVDQSWVLTAAHCGNKPLWARVGDDHLLLLQGEQLRRTTRSVVHPKYHQGSGPILPRRTDEHDLMLLKLARPVVLGPRVRALQLPYRCAQPGDQCQVAGWGTTAARRVKYNKGLTCSSITILSPKECEVFYPGVVTNNMICAGLDRGQDPCQSDSGGPLVCDETLQGILSWGVYPCGSAQHPAVYTQICKYMSWINKVIRSN

SEQ ID NO: 223 - protein, 62 aa, Homo sapiens
MSERQGAGATNGKDKTSGENDGQKKVQEEFDIDMDAPETERAAVAIQSQFRKFQKKKAGSQS

SEQ ID NO: 224 - protein, 598 aa, Homo sapiens; identical to SEQ ID NO: 204

SEQ ID NO: 225 - protein, 291 aa, Homo sapiens
MQRARPTLWAAALTLLVLLRGPPVARAGASSAGLGPVVRCEPCDARALAQCAPPPAVCAELVREPGCGCCLTCALSEGQPCGIYTERCGSGLRCQPSPDEARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 226 - protein, 712 aa, Homo sapiens
MSQWYELQQLDSKFLEQVHQLYDDSFPMEIRQYLAQWLEKQDWEHAANDVSFATIRFHDLLSQLDDQYSRFSLENNFLLQHNIRKSKRNLQDNFQEDPIQMSMIIYSCLKEERKILENAQRFNQAQSGNIQSTVMLDKQKELDSKVRNVKDKVMCIEHEIKSLEDLQDEYDFKCKTLQNREHETNGVAKSDQKQEQLLLKKMYLMLDNKRKEVVHKIIELLNVTELTQNALINDELVEWKRRQQSACIGGPPNACLDQLQNWFTIVAESLQQVRQQLKKLEELEQKYTYEHDPITKNKQVLWDRTFSLFQQLIQSSFVVERQPCMPTHPQRPLVLKTGVQFTVKLRLLVKLQELNYNLKVKVLFDKDVNERNTVKGFRKFNILGTHTKVMNMEESTNGSLAAEFRHLQLKEQKNAGTRTNEGPLIVTEELHSLSFETQLCQPGLVIDLETTSLPVVVISNVSQLPSGWASILWYNMLVAEPRNLSFFLTPPCARWAQLSEVLSWQFSSVTKRGLNVDQLNMLGEKLLGPNASPDGLIPWTRFCKENINDKNFPFWLWIESILELIKKHLLPLWNDGCIMGFISKERERALLKDQQPGTFLLRFSESSREGAITFTWVERSQNGGEPDFHAVEPYTKKELSAVTFPDIIRNYKVMAAENIPENPLKYLYPNIDKDHAFGKYYSRPKEAPEPMELDGPKGTGYIKTELISVSEV

SEQ ID NO: 227 - protein, 543 aa, Homo sapiens
MGTSLSPNDPWPLNPLSIQQTTLLLLLSVLATVHVGQRLLRQRRRQLRSAPPGPFAWPLIGNAAAVGQAAHLSFARLARRYGDVFQIRLGSCPIVVLNGERAIHQALVQQGSAFADRPAFASFRVVSGGRSMAFGHYSEHWKVQRRAAHSMMRNFFTRQPRSRQVLEGHVLSEARELVALLVRGSADGAFLDPRPLTVVAVANVMSAVCFGCRYSHDDPEFRELLSHNEEFGRTVGAGSLVDVMPWLQYFPNPVRTVFREFEQLNRNFSNFILDKFLRHCESLRPGAAPRDMMDAFILSAEKKAAGDSHGGGARLDLENVPATITDIFGASQDTLSTALQWLLLLFTRYPDVQTRVQAELDQVVGRDRLPCMGDQPNLPYVLAFLYEAMRFSSFVPVTIPHATTANTSVLGYHIPKDTVVFVNQWSVNHDPVKWPNPENFDPARFLDKDGLINKDLTSRVMIFSVGKRRCIGEELSKMQLFLFISILAHQCDFRANPNEPAKMNFSYGLTIKPKSFKVNVTLRESMELLDSAVQNLQAKETCQ

SEQ ID NO: 228 - protein, 1464 aa, Homo sapiens
MFSFVDLRLLLLLAATALLTHGQEEGQVEGQDEDIPPITCVQNGLRYHDRDVWKPEPCRICVCDNGKVLCDDVICDETKNCPGAEVPEGECCPVCPDGSESPTDQETTGVEGPKGDTGPRGPRGPAGPPGRDGIPGQPGLPGPPGPPGPPGPPGLGGNFAPQLSYGYDEKSTGGISVPGPMGPSGPRGLPGPPGAPGPQGFQGPPGEPGEPGASGPMGPRGPPGPPGKNGDDGEAGKPGRPGERGPPGPQGARGLPGTAGLPGMKGHRGFSGLDGAKGDAGPAGPKGEPGSPGENGAPGQMGPRGLPGERGRPGAPGPAGARGNDGATGAAGPPGPTGPAGPPGFPGAVGAKGEAGPQGPRGSEGPQGVRGEPGPPGPAGAAGPAGNPGADGQPGAKGANGAPGIAGAPGFPGARGPSGPQGPGGPPGPKGNSGEPGAPGSKGDTGAKGEPGPVGVQGPPGPAGEEGKRGARGEPGPTGLPGPPGERGGPGSRGFPGADGVAGPKGPAGERGSPGPAGPKGSPGEAGRPGEAGLPGAKGLTGSPGSPGPDGKTGPPGPAGQDGRPGPPGPPGARGQAGVMGFPGPKGAAGEPGKAGERGVPGPPGAVGPAGKDGEAGAQGPPGPAGPAGERGEQGPAGSPGFQGLPGPAGPPGEAGKPGEQGVPGDLGAPGPSGARGERGFPGERGVQGPPGPAGPRGANGAPGNDGAKGDAGAPGAPGSQGAPGLQGMPGERGAAGLPGPKGDRGDAGPKGADGSPGKDGVRGLTGPIGPPGPAGAPGDKGESGPSGPAGPTGARGAPGDRGEPGPPGPAGFAGPPGADGQPGAKGEPGDAGAKGDAGPPGPAGPAGPPGPIGNVGAPGAKGARGSAGPPGATGFPGAAGRVGPPGPSGNAGPPGPPGPAGKEGGKGPRGETGPAGRPGEVGPPGPPGPAGEKGSPGADGPAGAPGTPGPQGIAGQRGVVGLPGQRGERGFPGLPGPSGEPGKQGPSGASGERGPPGPMGPPGLAGPPGESGREGAPGAEGSPGRDGSPGAKGDRGETGPAGPPGAPGAPGAPGPVGPAGKSGDRGETGPAGPAGPVGPVGARGPAGPQGPRGDKGETGEQGDRGIKGHRGFSGLQGPPGPPGSPGEQGPSGASGPAGPRGPPGSAGAPGKDGLNGLPGPIGPPGPRGRTGDAGPVGPPGPPGPPGPPGPPSAGFDFSFLPQPPQEKAHDGGRYYRADDANVVRDRDLEVDTTLKSLSQQIENIRSPEGSRKNPARTCRDLKMCHSDWKSGEYWIDPNQGCNLDAIKVFCNMETGETCVYPTQPSVAQKNWYISKNPKDKRHVWFGESMTDGFQFEYGGQGSDPADVAIQLTFLRLMSTEASQNITYHCKNSVAYMDQQTGNLKKALLLQGSNEIEIRAEGNSRFTYSVTVDGCTSHTGAWGKTVIEYKTTKTSRLPIIDVAPLDVGAPDQEFGFDVGPVCFL

SEQ ID NO: 229 - protein, 248 aa, Homo sapiens
MGMERPAAREPHGPDALRRFQGLLLDRRGRLHRQVLRLREVARRLERLRRRSLVANVAGSSLSATGALAAIVGLSLSPVTLGTSLLVSAVGLGVATAGGAVTITSDLSLIFCNSRELRRVQEIAATCQDQMREILSCLEFFCRWQGCGDRQLLQCGRNASIALYNSVYFIVFFGSRGFLIPRRAEGDTKVSQAVLKAKIQKLAESLESCTGALDELSEQLESRVQLCTKSSRGHDLKISADQRAGLFF

SEQ ID NO: 230 - protein, 451 aa, Homo sapiens
MRECISIHVGQAGVQIGNACWELYCLEHGIQPDGQMPSDKTIGGGDDSFNTFFSETGAGKHVPRAVFVDLEPTVIDEVRTGTYRQLFHPEQLITGKEDAANNYARGHYTIGKEIIDLVLDRIRKLADQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLIGQIVSSITASLRFDGALNVDLTEFQTNLVPYPRIHFPLATYAPVISAEKAYHEQLSVAEITNACFEPANQMVKCDPRHGKYMACCLLYRGDVVPKDVNAAIATIKTKRTIQFVDWCPTGFKVGINYQPPTVVPGGDLAKVQRAVCMLSNTTAIAEAWARLDHKFDLMYAKRAFVHWYVGEGMEEGEFSEAREDMAALEKDYEEVGVDSVEGEGEEEGEEY

SEQ ID NO: 231 - protein, 247 aa, Homo sapiens [sequence omitted]

SEQ ID NO: 232 - protein, 1651 aa, Homo sapiens
MKWKHVPFLVMISLLSLSPNHLFLAQLIPDPEDVERGNDHGTPIPTSDNDDNSLGYTGSRLRQEDFPPRIVEHPSDLIVSKGEPATLNCKAEGRPTPTIEWYKGGERVETDKDDPRSHRMLLPSGSLFFLRIVHGRKSRPDEGVYVCVARNYLGEAVSHNASLEVAILRDDFRQNPSDVMVAVGEPAVMECQPPRGHPEPTISWKKDGSPLDDKDERITIRGGKLMITYTRKSDAGKYVCVGTNMVGERESEVAELTVLERPSFVKRPSNLAVTVDDSAEFKCEARGDPVPTVRWRKDDGELPKSRYEIRDDHTLKIRKVTAGDMGSYTCVAENMVGKAEASATLTVQEPPHFVVKPRDQVVALGRTVTFQCEATGNPQPAIFWRREGSQNLLFSYQPPQSSSRFSVSQTGDLTITNVQRSDVGYYICQTLNVAGSIITKAYLEVTDVIADRPPPVIRQGPVNQTVAVDGTFVLSCVATGSPVPTILWRKDGVLVSTQDSRIKQLENGVLQIRYAKLGDTGRYTCIASTPSGEATWSAYIEVQEFGVPVQPPRPTDPNLIPSAPSKPEVTDVSRNTVTLSWQPNLNSGATPTSYIIEAFSHASGSSWQTVAENVKTETSAIKGLKPNAIYLFLVRAANAYGISDPSQISDPVKTQDVLPTSQGVDHKQVQRELGNAVLHLHNPTVLSSSSIEVHWTVDQQSQYIQGYKILYRPSGANHGESDWLVFEVRTPAKNSVVIPDLRKGVNYEIKARPFFNEFQGADSEIKFAKTLEEAPSAPPQGVTVSKNDGNGTAILVSWQPPPEDTQNGMVQEYKVWCLGNETRYHINKTVDGSTFSVVIPFLVPGIRYSVEVAASTGAGSGVKSEPQFIQLDAHGNPVSPEDQVSLAQQISDVVKQPAFIAGIGAACWIILMVFSIWLYRHRKKRNGLTSTYAGIRKVPSFTFTPTVTYQRGGEAVSSGGRPGLLNISEPAAQPWLADTWPNTGNNHNDCSISCCTAGNGNSDSNLTTYSRPADCIANYNNQLDNKQTNLMLPESTVYGDVDLSNKINEMKTFNSPNLKDGRFVNPSGQPTPYATTQLIQSNLSNNMNNGSGDSGEKHWKPLGQQKQEVAPVQYNIVEQNKLNKDYRANDTVPPTIPYNQSYDQNTGGSYNSSDRGSSTSGSQGHKKGARTPKVPKQGGMNWADLLPPPPAHPPPHSNSEEYNISVDESYDQEMPCPVPPARMYLQQDELEEEEDERGPTPPVRGAASSPAAVSYSHQSTATLTPSPQEELQPMLQDCPEETGHMQHQPDRRRQPVSPPPPPRPISPPHTYGYISGPLVSDMDTDAPEEEEDEADMEVAKMQTRRLLLRGLEQTPASSVGDLESSVTGSMINGWGSASEEDNISSGRSSVSSSDGSFFTDADFAQAVAAAAEYAGLKVARRQMQDAAGRRHFHASQCPRPTSPVSTDSNMSAAVMQKTRPAKKLKHQPGHLRRETYTDDLPPPPVPPPAIKSPTAQSKTQLEVRPVVVPKLPSMDARTDRSSDRKGSSYKGREVLDGRQVVDMRTNPGDPREAQEQQNDGKGRGNKAAKRDLPPAKTHLIQEDILPYCRPTFPTSNNPRDPSSSSSMSSRGSGSRQREQANVGRRNIAEMQVLGGYERGEDNNEELEETES

SEQ ID NO: 233 - protein, 457 aa, Homo sapiens
MRSAAVLALLLCAGQVTALPVNSPMNKGDTEVMKCIVEVISDTLSKPSPMPVSQECFETLRGDERILSILRHQNLLKELQDLALQGAKERAHQQKKHSGFEDELSEVLENQSSQAELKEAVEEPSSKDVMEKREDSKEAEKSGEATDGARPQALPEPMQESKAEGNNQAPGEEEEEEEEATNTHPPASLPSQKYPGPQAEGDSEGLSQGLVDREKGLSAEPGWQAKREEEEEEEEEAEAGEEAVPEEEGPTVVLNPHPSLGYKEIRKGESRSEALAVDGAGKPGAEEAQDPEGKGEQEHSQQKEEEEEMAVVPQGLFRGGKSGELEQEEERLSKEWEDSKRWSKMDQLAKELTAEKRLEGQEEEEDNRDSSMKLSFRARAYGFRGPGPQLRRGWRPSSREDSLEAGLPLQVRGYPEEKKEEEGSANRRPEDQELESLSAIEAELEKVAHQLQALRRG

SEQ ID NO: 234 - protein, 535 aa, Homo sapiens
MEEGARHRNNTEKKHPGGGESDASPEAGSGGGGVALKKEIGLVSACGIIVGNIIGSGIFVSPKGVLENAGSVGLALIVWIVTGFITVVGALCYAELGVTIPKSGGDYSYVKDIFGGLAGFLRLWIAVLVIYPTNQAVIALTFSNYVLQPLFPTCFPPESGLRLLAAICLLLLTWVNCSSVRWATRVQDIFTAGKLLALALIIIMGIVQICKGEYFWLEPKNAFENFQEPDIGLVALAFLQGSFAYGGWNFLNYVTEELVDPYKNLPRAIFISIPLVTFVYVFANVAYVTAMSPQELLASNAVAVTFGEKLLGVMAWIMPISVALSTFGGVNGSLFTSSRLFFAGAREGHLPSVLAMIHVKRCTPIPALLFTCISTLLMLVTSDMYTLINYVGFINYLFYGVTVAGQIVLRWKKPDIPRPIKINLLFPIIYLLFWAFLLVFSLWSEPVVCGIGLAIMLTGVPVYFLGVYWQHKPKCFSDFIELLTLVSQKMCVVVYPEVERGSGTEEANEDMEEQQQPMYQPTPTKDKDVAGQPQP

SEQ ID NO: 235 - protein, 319 aa, Homo sapiens
MVGKMWPVLWTLCAVRVTVDAISVETPQDVLRASQGKSVTLPCTYHTSTSSREGLIQWDKLLLTHTERVVIWPFSNKNYIHGELYKNRVSISNNAEQSDASITIDQLTMADNGTYECSVSLMSDLEGNTKSRVRLLVLVPPSKPECGIEGETIIGNNIQLTCQSKEGSPTPQYSWKRYNILNQEQPLAQPASGQPVSLKNISTDTSGYYICTSSNEEGTQFCNITVAVRSPSMNVALYVGIAVGVVAALIIIGIIIYCCCCRGKDDNTEDKEDARPNREAYEEPPEQLRELSREREEEDDYRQEEQRSTGRESPDHLDQ

SEQ ID NO: 236 - protein, 297 aa, Homo sapiens
MDAEGLALLLPPVTLAALVDSWLREDCPGLNYAALVSGAGPSQAALWAKSPGVLAGQPFFDAIFTQLNCQVSWFLPEGSKLVPVARVAEVRGPAHCLLLGERVALNTLARCSGIASAAAAAVEAARGAGWTGHVAGTRKTTPGFRLVEKYGLLVGGAASHRYDLGGLVMVKDNHVVAAGGVEKAVRAARQAADFALKVEVECSSLQEAVQAAEAGADLVLLDNFKPEELHPTATVLKAQFPSVAVEASGGITLDNLPQFCGPHIDVISMGMLTQAAPALDFSLKLFAKEVAPVPKIH

SEQ ID NO: 237 - protein, 480 aa, Homo sapiens
MNASEFRRRGKEMVDYVANYMEGIEGRQVYPDVEPGYLRPLIPAAAPQEPDTFEDIINDVEKIIMPGVTHWHSPYFFAYFPTASSYPAMLADMLCGAIGCIGFSWAASPACTELETVMMDWLGKMLELPKAFLNEKAGEGGGVIQGSASEATLVALLAARTKVIHRLQAASPELTQAAIMEKLVAYSSDQAHSSVERAGLIGGVKLKAIPSDGNFAMRASALQEALERDKAAGLIPFFMVATLGTTTCCSFDNLLEVGPICNKEDIWLHVDAAYAGSAFICPEFRHLLNGVEFADSFNFNPHKWLLVNFDCSAMWVKKRTDLTGAFRLDPTYLKHSHQDSGLITDYRHWQIPLGRRFRSLKMWFVFRMYGVKGLQAYIRKHVQLSHEFESLVRQDPRFEICVEVILGLVCFRLKGSNKVNEALLQRINSAKKIHLVPCHLRDKFVLRFAICSRTVESAHVQRAWEHIKELAADVLRAERE

SEQ ID NO: 238 - protein, 1806 aa, Homo sapiens
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEYAPEDIIEYDYEYGEAEYKEAESVTEGPTVTEETIAQTEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKGPQGKPGLAGLPGADGPPGHPGKEGQSGEKGALGPPGPQGPIGYPGPRGVKGADGVRGLKGSKGEKGEDGFPGFKGDMGLKGDRGEVGQIGPRGEDGPEGPKGRAGPTGDPGPSGQAGEKGKLGVPGLPGYPGRQGPKGSTGFPGFPGANGEKGARGVAGKPGPRGQRGPTGPRGSRGARGPTGKPGPKGTSGGDGPPGPPGERGPQGPQGPVGFPGPKGPPGPPGKDGLPGHPGQRGETGFQGKTGPPGPGGVVGPQGPTGETGPIGERGHPGPPGPPGEQGLPGAAGKEGAKGDPGPQGISGKDGPAGLRGFPGERGLPGAQGAPGLKGGEGPQGPPGPVGSPGERGSAGTAGPIGLPGRPGPQGPPGPAGEKGAPGEKGPQGPAGRDGVQGPVGLPGPAGPAGSPGEDGDKGEIGEPGQKGSKGDKGENGPPGPPGLQGPVGAPGIAGGDGEPGPRGQQGMFGQKGDEGARGFPGPPGPIGLQGLPGPPGEKGENGDVGPMGPPGPPGPRGPQGPNGADGPQGPPGSVGSVGGVGEKGEPGEAGNPGPPGEAGVGGPKGERGEKGEAGPPGAAGPPGAKGPPGDDGPKGNPGPVGFPGDPGPPGEPGPAGQDGVGGDKGEDGDPGQPGPPGPSGEAGPPGPPGKRGPPGAAGAEGRQGEKGAKGEAGAEGPPGKTGPVGPQGPAGKPGPEGLRGIPGPVGEQGLPGAAGQDGPPGPMGPPGLPGLKGDPGSKGEKGHPGLIGLIGPPGEQGEKGDRGLPGTQGSPGAKGDGGIPGPAGPLGPPGPPGLPGPQGPKGNKGSTGPAGQKGDSGLPGPPGSPGPPGEVIQPLPILSSKKTRRHTEGMQADADDNILDYSDGMEEIFGSLNSLKQDIEHMKFPMGTQTNPARTCKDLQLSHPDFPDGEYWIDPNQGCSGDSFKVYCNFTSGGETCIYPDKKSEGVRISSWPKEKPGSWFSEFKRGKLLSYLDVEGNSINMVQMTFLKLLTASARQNFTYHCHQSAAWYDVSSGSYDKALRFLGSNDEEMSYDNNPFIKTLYDGCASRKGYEKTVIEINTPKIDQVPIVDVMINDFGDQNQKFGFEVGPVCFLG

SEQ ID NO: 239 - protein, 201 aa, Homo sapiens
MVSWIISRLVVLIFGTLYPAYYSYKAVKSKDIKEYVKWMMYWIIFALFTTAETFTDIFLCWFPFYYELKIAFVAWLLSPYTKGSSLLYRKFVHPTLSSKEKEIDDCLVQAKDRSYDALVHFGKRGLNVAATAAVMAASKGQGALSERLRSFSMQDLTTIRGDGAPAPSGPPPPGSGRASGKHGQPKMSRSASESASSSGTA

SEQ ID NO: 240 - protein, 871 aa, Homo sapiens; identical to SEQ ID NO: 213

SEQ ID NO: 241 - protein, 449 aa, Homo sapiens
MLPAATASLLGPLLTACALLPFAQGQTPNYTRPVFLCGGDVKGESGYVASEGFPNSYPPNKECIWTITVPEGQTVSLSFRVFDLELHPACRYDALEVFAGSGTSGQRLGRFCGTFRPAPLVAPGNQVTLRMTTDEGTGGRGFLLWYSGRATSGSEHQFCGGRLEKAQGTLTTPNWPESDYPPGISCSWHIIAPPDQVIALTFEKFDLEPDTYCRYDSVSVFNGAVSDDSRRLGKFCGDAVPGSISSEGNELLVQFVSDLSVTADGFSASYKTLPRGTAKEGQGPGPKRGTEPKVKLPPKSQPPEKTEESPSAPDAPTCPKQCRRTGTLQSNFCASSLVVTATVKSMVREPGEGLAVTVSLIGAYKTGGLDLPTPPTGASLKFYVPCKQCPPMKKGVSYLLMGQVEENRGPVLPPESFVVLHRPNQDQILTNLSKRKCPSQPVRAAASQD

SEQ ID NO: 242 - protein, 2797 aa, Homo sapiens
GLGGCVCAEVEAEVSLPSMQGDLKTTDISIEPPSAQLEVQAGQVDLKLPEGHVPEGAGLKGHLPKLQMPSFKMPKVDRKGPQIDVKGPKLDLKGPKTDVTAPDVEVSQPGMEVDVEAPGAKLDGARLEGDLSLADKDVTAKDSKFKMPKFKMPSFGVSAPGKSIEVLVDVSAPKVEADLSLPSMQGDLKNTDISIELPSVQLEVQAGQVDVKLPEGHVLEGAGLKGHLPKLQMPSFKMPKVDRKGPQIDIKGPKLDLKGPKMDVTAPDVEVSQPSMEVDVEAPGAKLDGARLEGDLSLADKDVTAKDSKFKMPKFKMPSYRASAPGKSIQASVDVSAPKAEADVSLPSMQGDLKTTDLSIQLPSVDLEVQAGQVDVKLPEGHVPEGAGLKGHLPKVEMPSFKMPKVDLKSPQVDIKGPKLDLKVPKAEVTVPDVEVSLPSVEVDVQAPRAKLDGARLEGDLSLAEKDVTAKDSKFKMPKFKMPSFGVSAPGRSIEASLDVSAPKVEADVSLSSMQGDLKATDLSIQPPSADLEVQAVQVDVELLEGPVPEGAGLKGHLPKVEMPSLKTPKVDLKGPQIDVKGPKLDLKGPKAEVRVPDVEVSLPSVEVDVQAPKAKLDAGRLEGDLSLADKDVTAKDSKFKMPKFKMPSFRVSAPGKSMEASVDVSAPKVEADVSLPSMQGDLKTTDLSIQPPSADLKVQAGQMDVKLPEGQVPEGAGLKEHLPKVEMPSLKMPKVDLKGPQVDIKGPKLDLKVSKAEVTAPDVEVSLPSVEVDVQAPRAKLDSAQLEGDLSLADKDVTAKDSKFKMPKFKMPSFGVSAPGKSIEASVHVSAPKVEADVSLPSMQGDLKTTDLSIQPHSADLTVQARQVDMKLLEGHVPEEAGLKGHLPKVQMPSFKMPKVDLKGPEIDIKGPKLDLKDPKVEVTAPDVEVSLPSVEVDVEAPGAKLDGARLEGDLSLADKDMTAKDSKFKMPKFKMPSFGVSAPGKSMEASVDVTAPKVEADVSLPSMQGDLKATDLSVQPPSADLEVQAGQVDVKLPEGPVPEGASLKGHLPKVQMPSFKMPKVDLKGPQIDVKGPKLDLKGPKAEVTAPDVKMSLSSMEVDVQAPRAKLDGVQLEGDLSLADKDVTAKDSKFKMPKFKMPSFGVSAPGKSMEASVDVSELKAKADVSLPSMQGDLKTTDLSIQSPSADLEVQAGQVDVKLPEGPLPKGAGLKGHLPKVQMPCLKMPKVALKGPQVDVKGPKLDLKGPKADVMTPVVEVSLPSMEVDVEAPGAKLDSVRLEGDLSLADKDMTAKDSKFKMPKFKMPSFGVSAPGKSIEASLDVSALKVEADVSLPSMQGDLKTTHLSIQPPSADLEVQAGQEDVKLPEGPVHEGAGLKGHLPKLQMPSFKVPKVDLKGPQIDVNVPKLDLKGPKVEVTSPNLDVSLPSMEVDIQAPGAKLDSTRLEGDLSLADKDVTAKDSKFKMPKFKMPSFGMLSPGKSIEVSVDVSAPKMEADMSIPSMQGDLKTTDLRIQAPSADLEVQAGQVDLKLPEGHMPEVAGLKGHLPKVEMPSFKMPKVDLKGPQVDVKGPKLDLKGPKAEVMAPDVEVSLPSVETDVQAPGSMLDGARLEGDLSLAHEDVAGKDSKFQGPKLSTSGFEWSSKKVSMSSSEIEGNVTFHEKTSTFPIVESVVHEGDLHDPSRDGNLGLAVGEVGMDSKFKKLHFKVPKVSFSSTKTPKDSLVPGAKSSIGLSTIPLSSSECSSFELQQVSACSEPSMQMPKVGFAGFPSSRLDLTGPHFESSILSPCEDVTLTKYQVTVPRAALAPELALEIPSGSQADIPLPKTECSTDLQPPEGVPTSQAESHSGPLNSMIPVSLGQVSFPKFYKPKFVFSVPQMAVPEGDLHAAVGAPVMSPLSPGERVQCPLPSTQLPSPGTCVSQGPEELVASLQTSVVAPGEAPSEDADHEGKGSPLKMPKIKLPSFRWSPKKETGPKVDPECSVEDSKLSLVLDKDEVAPQSAIHMDLPPERDGEKGRSTKPGFAMPKLALPKMKASKSGVSLPQRDVDPSLSSATAGGSFQDTEKASSDGGRGGLGATASATGSEGVNLHRPQVHIPSLGFAKPDLRSSKAKVEVSQPEADLPLPKHDLSTEGDSRGCGLGDVPVSQPCGEGIAPTPEDPLQPSCRKPDAEVLTVESPEEEAMTKYSQESWFKMPKFRMPSLRRSFRDRGGAGKLEVAQTQAPAATGGEAAAKVKEFLVSGSNVEAAMSLQLPEADAEVTASESKSSTDILRCDLDSTGLKLHLSTAGMTGDELSTSEVRIHPSKGPLPFQMPGMRLPETQVLPGEIDETPLSKPGHDLASMEDKTEKWSSQPEGPLKLKASSTDMPSQISVVNVDQLWEDSVLTVKFPKLMVPRFSFPAPSSEDDVFIPTVREVQCPEANIDTALCKESPGLWGASILKAGAGVPGEQPVDLNLPLEAPPISKVRVHIQGAQVESQEVTIHSIVTPEFVDLSVPRTFSTQIVRESEIPTSEIQTPSYGFSLLKVKIPEPHTQARVYTTMTQHSRTQEGTEEAPIQATPGVDSISGDLQPDTGEPFEMISSSVNVLGQQTLTFEVPSGHQLADSCSDEEPAEILEFPPDDSQEATTPLADEGRAPKDKPESKKSGLLWFWLPNIGFSSSVDETGVDSKNDVQRSAPIQTQPEARPEAELPKKQEKAGWFRFPKLGFSSSPTKKSKSTEDGAELEEQKLQEETITFFDARESFSPEEKEEGELIGPVGTGLDSRVMVTSAARTELILPEQDRKADDESKGSGLGPNEG

SEQ ID NO: 243 - protein, 352 aa, Homo sapiens; identical to SEQ ID NO: 158

SEQ ID NO: 244 - protein, 3396 aa, Homo sapiens; identical to SEQ ID NO: 166

SEQ ID NO: 245 - protein, 418 aa, Homo sapiens
MQALVLLLCIGALLGHSSCQNPASPPEEGSPDPDSTGALVEEEDPFFKVPVNKLAAAVSNFGYDLYRVRSSTSPTTNVLLSPLSVATALSALSLGAEQRTESIIHRALYYDLISSPDIHGTYKELLDTVTAPQKNLKSASRIVFEKKLRIKSSFVAPLEKSYGTRPRVLTGNPRLDLQEINNWVQAQMKGKLARSTKEIPDEISILLLGVAHFKGQWVTKFDSRKTSLEDFYLDEERTVRVPMMSDPKAVLRYGLDSDLSCKIAQLPLTGSMSIIFFLPLKVTQNLTLIEESLTSEFIHDIDRELKTVQAVLTVPKLKLSYEGEVTKSLQEMKLQSLFDSPDFSKITGKPIKLTQVEHRAGFEWNEDGAGTTPSPGLQPAHLTFPLDYHLNQPFIFVLRDTDTGALLFIGKILDPRGP

SEQ ID NO: 246 - protein, 807 aa, Homo sapiens
MRLSPAPLKLSRTPALLALALPLAAALAFSDETLDKVPKSEGYCSRILRAQGTRREGYTEFSLRVEGDPDFYKPGTSYRVTLSAAPPSYFRGFTLIALRENREGDKEEDHAGTFQIIDEEETQFMSNCPVAVTESTPRRRTRIQVFWIAPPAGTGCVILKASIVQKRIIYFQDEGSLTKKLCEQDSTFDGVTDKPILDCCACGTAKYRLTFYGNWSEKTHPKDYPRRANHWSAIIGGSHSKNYVLWEYGGYASEGVKQVAELGSPVKMEEEIRQQSDEVLTVIKAKAQWPAWQPLNVRAAPSAEFSVDRTRHLMSFLTMMGPSPDWNVGLSAEDLCTKECGWVQKVVQDLIPWDAGTDSGVTYESPNKPTIPQEKIRPLTSLDHPQSPFYDPEGGSITQVARVVIERIARKGEQCNIVPDNVDDIVADLAPEEKDEDDTPETCIYSNWSPWSACSSSTCDKGKRMRQRMLKAQLDLSVPCPDTQDFQPCMGPGCSDEDGSTCTMSEWITWSPCSISCGMGMRSRERYVKQFPEDGSVCTLPTEETEKCTVNEECSPSSCLMTEWGEWDECSATCGMGMKKRHRMIKMNPADGSMCKAETSQAEKCMMPECHTIPCLLSPWSEWSDCSVTCGKGMRTRQRMLKSLAELGDCNEDLEQVEKCMLPECPIDCELTEWSQWSECNKSCGKGHVIRTRMIQMEPQFGGAPCPETVQRKKCRIRKCLRNPSIQKLRWREARESRRSEQLKEESEGEQFPGCRMRPWTAWSECTKLCGGGIQERYMTVKKRFKSSQFTSCKDKKEIRACNVHPC

SEQ ID NO: 247 - protein, 1806 aa, Homo sapiens; identical to SEQ ID NO: 238

SEQ ID NO: 248 - protein, 323 aa, Homo sapiens
MAAELSMGPELPTSPLAMEYVNDFDLLKFDVKKEPLGRAERPGRPCTRLQPAGSVSSTPLSTPCSSVPSSPSFSPTEQKTHLEDLYWMASNYQQMNPEALNLTPEDAVEALIGSHPVPQPLQSFDSFRGAHHHHHHHHPHPHHAYPGAGVAHDELGPHAHPHHHHHHQASPPPSSAASPAQQLPTSHPGPGPHATASATAAGGNGSVEDRFSDDQLVSMSVRELNRHLRGFTKDEVIRLKQKRRTLKNRGYAQSCRYKRVQQKHHLENEKTQLIQQVEQLKQEVSRLARERDAYKVKCEKLANSGFREAGSTSDSPSSPEFFL

SEQ ID NO: 249 - protein, 729 aa, Homo sapiens
MPTGFVAPILCVLLPSPTREAATVASATGDSASERESAAPAAAPTAEAPPPSVVTRPEPQALPSPAIRAPLPDLYPFGTMRGGGFGDRDRDRDRGGFGARGGGGLPPKKFGNPGERLRKKKWDLSELPKFEKNFYVEHPEVARLTPYEVDELRRKKEITVRGGDVCPKPVFAFHHANFPQYVMDVLMDQHFTEPTPIQCQGFPLALSGRDMVGIAQTGSGKTLAYLLPAIVHINHQPYLERGDGPICLVLAPTRELAQQVQQVADDYGKCSRLKSTCIYGGAPKGPQIRDLERGVEICIATPGRLIDFLESGKTNLRRCTYLVLDEADRMLDMGFEPQIRKIVDQIRPDRQTLMWSATWPKEVRQLAEDFLRDYTQINVGNLELSANHNILQIVDVCMESEKDHKLIQLMEEIMAEKENKTIIFVETKRRCDDLTRRMRRDGWPAMCIHGDKSQPERDWVLNEFRSGKAPILIATDVASRGLDVEDVKFVINYDYPNSSEDYVHRIGRTARSTNKGTAYTFFTPGNLKQARELIKVLEEANQAINPKLMQLVDHRGGGGGGGGRSRYRTTSSANNPNLMYQDECDRRLRGVKDGGRRDSASYRDRSETDRAGYANGSGYGSPNSAFGAQAGQYTYGQGTYGAAAYGTSSYTAQEYGAGTYGASSTTSTGRSSQSSSQQFSGIGRSGQQPQPLMSQQFAQPPGATNMIGYMGQTAYQYPPPPPPPPPSRK

SEQ ID NO: 250 - protein, 259 aa, Homo sapiens
MLESSGCKALKEGVLEKRSDGLLQLWKKKCCILTEEGLLLIPPKQLQHQQQQQQQQQQQQQQPGQGPAEPSQPSGPAVASLEPPVKLKELHFSNMKTVDCVERKGKYMYFTVVMAEGKEIDFRCPQDQGWNAEITLQMVQYKNRQAILAVKSTRQKQQHLVQQQPPSQPQPQPQLQPQPQPQPQPQPQPQSQPQPQPQPKPQPQQLHPYPHPHPHPHSHPHSHPHPHPHPHPHQIPHPHPQPHSQPHGHRLLRSTSNSA

SEQ ID NO: 251 - protein, 510 aa, Homo sapiens
MDGFYDQQVPFMVPGKSRSEECRGRPVIDRKRKFLDTDLAHDSEELFQDLSQLQEAWLAEAQVPDDEQFVPDFQSDNLVLHAPPPTKIKRELHSPSSELSSCSHEQALGANYGEKCLYNYCAYDRKPPSGFKPLTPPTTPLSPTHQNPLFPPPQATLPTSGHAPAAGPVQGVGPAPAPHSLPEPGPQQQTFAVPRPPHQPLQMPKMMPENQYPSEQRFQRQLSEPCHPFPPQPGVPGDNRPSYHRQMSEPIVPAAPPPPQGFKQEYHDPLYEHGVPGMPGPPAHGFQSPMGIKQEPRDYCVDSEVPNCQSSYMRGGYFSSSHEGFSYEKDPRLYFDDTCVVPERLEGKVKQEPTMYREGPPYQRRGSLQLWQFLVTLLDDPANAHFIAWTGRGMEFKLIEPEEVARRWGIQKNRPAMNYDKLSRSLRYYYEKGIMQKVAGERYVYKFVCDPDALFSMAFPDNQRPFLKAESECHLSEEDTLPLTHFEDSPAYLLDMDRCSSLPYAEGFAY

SEQ ID NO: 252 - protein, 303 aa, Homo sapiens
MGRKVHSNGSQFAEHSRSPRRTGRDCKPVRAPSMALGVSQLAGRSRCLCSESQGGYERFSSEYPEFCSKTKALAAIPPPVPPSATEPLDLGCSSCGTPLHDQGGPVEILPFLYLGSAYHAARRDMLDALGITALLNVSSDCPNHFEGHYQYKCIPVEDNHKADISSWFMEAIEYIDAVKDCRGRVLVHCQAGISRSATICLAYLMMKKRVRLEEAFEFVKQRRSIISPNFSFMGQLLQFESQVLATSCAAEAASPSGPLRERGKTPATPTSQFVFSFPVSVGVHSAPSSLPYLHSPITTSPSC

SEQ ID NO: 253 - protein, 394 aa, Homo sapiens
MVTMEELREMDCSVLKRLMNRDENGGGAGGSGSHGTLGLPSGGKCLLLDCRPFLAHSAGYILGSVNVRCNTIVRRRAKGSVSLEQILPAEEEVRARLRSGLYSAVIVYDERSPRAESLREDSTVSLVVQALRRNAERTDICLLKGGYERFSSEYPEFCSKTKALAAIPPPVPPSATEPLDLGCSSCGTPLHDQGGPVEILPFLYLGSAYHAARRDMLDALGITALLNVSSDCPNHFEGHYQYKCIPVEDNHKADISSWFMEAIEYIDAVKDCRGRVLVHCQAGISRSATICLAYLMMKKRVRLEEAFEFVKQRRSIISPNFSFMGQLLQFESQVLATSCAAEAASPSGPLRERGKTPATPTSQFVFSFPVSVGVHSAPSSLPYLHSPITTSPSC

SEQ ID NO: 254 - protein, 388 aa, Homo sapiens
MGAAAWARPLSVSFLLLLLPLPGMPAGSWDPAGYLLYCPCMGRFGNQADHFLGSLAFAKLLNRTLAVPPWIEYQHHKPPFTNLHVSYQKYFKLEPLQAYHRVISLEDFMEKLAPTHWPPEKRVAYCFEVAAQRSPDKKTCPMKEGNPFGPFWDQFHVSFNKSELFTGISFSASYREQWSQRFSPKEHPVLALPGAPAQFPVLEEHRPLQKYMVWSDEMVKTGEAQIHAHLVRPYVGIHLRIGSDWKNACAMLKDGTAGSHFMASPQCVGYSRSTAAPLTMTMCLPDLKEIQRAVKLWVRSLDAQSVYVATDSESYVPELQQLFKGKVKVVSLKPEVAQVDLYILGQADHFIGNCVSSFTAFVKRERDLQGRPSSFFGMDRPPKLRDEF

SEQ ID NO: 255 - protein, 460 aa, Homo sapiens
MMEALGFLKLEVNGPMVTVALSVALLALLKWYSTSAFSRLEKLGLRHPKPSPFIGNLTFFRQGFWESQMELRKLYGPLCGYYLGRRMFIVISEPDMIKQVLVENFSNFTNRMASGLEFKSVADSVLFLRDKRWEEVRGALMSAFSPEKLNEMVPLISQACDLLLAHLKRYAESGDAFDIQRCYCNYTTDVVASVPFGTPVDSWQAPEDPFVKHCKRFFEFCIPRPILVLLLSFPSIMVPLARILPNKNRDELNGFFNKLIRNVIALRDQQAAEERRRDFLQMVLDARHSASPMGVQDFDIVRDVFSSTGCKPNPSRQHQPSPMARPLTVDEIVGQAFIFLIAGYEIITNTLSFATYLLATNPDCQEKLLREVDVFKEKHMAPEFCSLEEGLPYLDMVIAETLRMYPPAFRFTREAAQDCEVLGQRIPAGAVLEMAVGALHHDPEHWPSPETFNPERYRCS

SEQ ID NO: 256 - protein, 499 aa, Homo sapiens
MVDRGPLLTSAIIFYLAIGAAIFEVLEEPHWKEAKKNYYTQKLHLLKEFPCLGQEGLDKILEVVSDAAGQGVAITGNQTFNNWNWPNAMIFAATVITTIGYGNVAPKTPAGRLFCVFYGLFGVPLCLTWISALGKFFGGRAKRLGQFLTKRGVSLRKAQITCTVIFIVWGVLVHLVIPPFVFMVTEGWNYIEGLYYSFITISTIGFGDFVAGVNPSANYHALYRYFVELWIYLGLAWLSLFVNWKVSMFVEVHKAIKKRRRRRKESFESSPHSRKALQVKGSTASKDVNIFSFLSKKEETYNDLIKQIGKKAMKTSGGGETGPGPGLGPQGGGLPALPPSLVPLVVYSKNRVPTLEEVSQTLRSKGHVSRSPDEEAVARAPEDSSPAPEVFMNQLDRISEECEPWDAQDYHPLIFQDASITFVNTEAGLSDEETSKSSLEDNLAGEESPQQGAEAKAPLNMGEFPSSSESTFTSTESELSVPYEQLMNEYNKANSPKGT

SEQ ID NO: 257 - DNA, 22 bp, Artificial
  primer
taaggcctgctgaaaatgactg

SEQ ID NO: 258 - DNA, 22 bp, Artificial
  primer
tggtcctgcaccagtaatatgc

SEQ ID NO: 259 - DNA, 23 bp, Artificial
  primer
tcataatgcttgctctgatagga

SEQ ID NO: 260 - DNA, 22 bp, Artificial
  primer
ggccaaaaatttaatcagtgga

What is claimed is:

1. A method for predicting the likelihood a mammal that has a wild-type K-ras will respond therapeutically to a method of treating colorectal cancer with a therapy that comprises administering an anti-EGFR antibody that inhibits binding of EGF to EGFR, wherein the method for predicting comprises measuring the mRNA expression level of both epiregulin and amphiregulin biomarkers in a colorectal cancer sample of said mammal,
    wherein an increase in the level of said biomarkers relative to a predetermined level of said biomarkers in a colorectal cancer sample indicates an increased likelihood the mammal will respond therapeutically to said method of treating colorectal cancer.

2. The method of claim 1 further comprising the step of measuring at least one additional biomarker selected from Table 1.

3. The method of claim 1 wherein said colorectal cancer sample is a tissue sample comprising colorectal cancer cells and said tissue is fixed, paraffin-embedded, fresh, or frozen.

4. The method of claim 1 that further comprises the step of determining whether said colorectal cancer sample has the presence of a mutated K-RAS, wherein detection of a mutated K-RAS indicates a decreased likelihood the mammal will respond therapeutically to said method of treating colorectal cancer.

5. The method according to a claim 1, wherein said mammal is human.

6. The method according to claim 1, wherein said mammal is selected from the group consisting of: rat, mouse, dog, rabbit, pig sheep, cow, horse, cat, primate, and monkey.

7. The method according to claim 1, wherein said anti-EGFR antibody is selected from the group consisting of a monoclonal, polyclonal or single chain antibody.

8. The method of claim 7, wherein said anti-EGFR antibody cetuximab.

9. The method according to claim 8, further comprising the step of administering said anti-EGFR antibody to said mammal if the level of said biomarkers is increased relative to a predetermined level of said biomarkers in a colorectal cancer sample, wherein said anti-EGFR antibody inhibits binding of EGF to EGFR.

10. The method according to claim 7, wherein said anti-EGFR antibody is panitumumab.

11. The method according to claim 10, further comprising the step of administering said anti-EGFR antibody to said mammal if the level of said biomarkers is increased relative to a predetermined level of said biomarkers in a colorectal cancer sample, wherein said anti-EGFR antibody inhibits binding of EGF to EGFR.

12. The method according to claim 1, further comprising the step of administering said anti-EGFR antibody to said mammal if the level of said biomarkers is increased relative to a predetermined level of said biomarkers in a colorectal cancer sample, wherein said anti-EGFR antibody inhibits binding of EGF to EGFR.

13. A method for predicting the likelihood a mammal that has a wild-type K-ras will respond therapeutically to a method of treating colorectal cancer comprising administering an anti-EGFR antibody that inhibits binding of EGF to EGFR, wherein the method comprises:
 (a) measuring the mRNA expression level of both epiregulin and amphiregulin biomarkers in a colorectal cancer sample of said mammal;
 (b) administering an anti-EGFR antibody to said mammal, wherein said anti-EGFR antibody inhibits binding of EGF to EGFR;
 (c) following the administering step (b), measuring in a biological sample of said mammal the mRNA expression level of said biomarkers,
 wherein an increase in the level said biomarkers measured in step (c) compared to the level of said biomarkers measured in step (a) indicates an increased likelihood the mammal will respond therapeutically to said method of treating colorectal cancer.

14. The method according to claim 13, wherein said anti-EGFR antibody is selected from the group consisting of: a monoclonal, polyclonal or single chain antibody.

* * * * *

UNITED STATES PATENT AND TRADEMARK OFFICE
CERTIFICATE OF CORRECTION

| | | |
|---|---|---|
| PATENT NO. | : 8,129,114 B2 | Page 1 of 1 |
| APPLICATION NO. | : 11/990713 | |
| DATED | : March 6, 2012 | |
| INVENTOR(S) | : Shirin K. Ford et al. | |

It is certified that error appears in the above-identified patent and that said Letters Patent is hereby corrected as shown below:

<u>First Page, Column 1</u>
(Other Publications)
Line 1, "Auguest" should read -- August --; and
Line 3, "reslt" should read -- result --.

<u>Column 68</u>
Line 66, "to a" should read -- to --.

<u>Column 69</u>
Line 3, "pig sheep," should read -- pig, sheep, --;
Line 5, "of a" should read -- of: a --; and
Line 8, before "cetuximab." insert -- is --.

Signed and Sealed this
Ninth Day of October, 2012

David J. Kappos
*Director of the United States Patent and Trademark Office*